United States Patent 11,098,302 (IDENTIFICATION OF POLYNUCLEOTIDES ASSOCIATED WITH A SAMPLE) - sequence listing, part 98

SEQ ID NO: 337600 - DNA, 624 bp, Homo sapiens
  misc_feature: GZ8MTXP02FPF7F.39.25.C03.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctccagataccattggagaaattgtgatgacgcagtctccagccaccctgtctgtgtctccgaggggaaangccaccctctcctgcagggccagtcagagtatcaccagcaacttagcctggtacccacagaaactggccaggcctcccgaggcctcctnatctagtggtncactccaccgagggccctaacgtcggtacctaccccgaaacgtagggttcaacggtcgggacccgtagggttcggggtactaggggaaccaaggttaactttccgaaccttcctaccaaccctagtaccagcacgtcccgtgacctagttcgtaggtaaacgttcgttttaggttaagtttttcttacgtgttaccagtactagtaataatacgtgtacccttgtcgtcgtaggcgttacggacgaacgggtaaccaaggtagaaactacgaaaacgtacgtacggacgactaacgacacctagtctacgttcctacgtac

SEQ ID NO: 337601 - DNA, 577 bp, Homo sapiens
  misc_feature: GZ8MTXP02FJBBW.39.25.C03.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctcccagataccattggagaaattgtgatgacgcagtctccagccaccctgtctgtgtctccaggggaaangccaccctctcctgcagggccagtcagagtatcacagcaacttagcctggtaccacagaactggcaggctccagctctcatctatgtncatccacgagggccacgtggtactccccgaaactggttcaggtgccaggtcgggtctgggacagtacttcactctcaccntcagcagactggacgcctagaagtatttgctagttgtacttacgtgtcaagctaagttagtagggtagccttaccttacccttcccgtaacccgttccgggaacccgtaaaacgggggaccctaacggaccgttagggaaacgtaacgtttaaaaccgacgttaggtcggactcggacctaccgtactctacgttccttactaccg

SEQ ID NO: 337602 - DNA, 654 bp, Homo sapiens
  misc_feature: GZ8MTXP02IEPY8.39.25.C03.1.454.CMB.2.raw
tcagtcgcactagtcacgaccggtgctcgatttagtagtgtagatttgggtttgggggaagaggaagactgacggtcccccaggagttcaggtgctgggcacggtgggcatgtgtgagttttgtcacaagatttgggctcaactctcttgtccagtccctggtgcagctgctgcagtcggggactgaggtgaaggagcctgggtcctcggtgagggtctcctgcaaggcttcgtggaggcaccgttcggcaactatcctatcaccgtgggtgcgacacggcccctggagaaggacttgaggtgggtggaggcatcactccctcgctttgctacaccacctacgcacagaaactcaacgcagacgtcacgtacttccgctagaacgaactaccaacgaaccacgtacctactacaagaactgacaccacgtaccttaagtcgtaggacgaccgaaccggtaccttaaatttaacgtttacgtacgtacgaaccgaaagtacgaactaccctacccttaccgtaccgacgggaccggggaacccgaaacggggtacccgtacggggtaccctaacccggtcctacccgtaccgaccggaacccctacccgaaaccgtaccgggacccctacggttcccgttccccttaccccccgg

SEQ ID NO: 337603 - DNA, 646 bp, Homo sapiens
  misc_feature: GZ8MTXP02ISWB8.39.25.C03.1.454.CMB.2.raw
  modified_base (198)..(198): a, c, t, g, unknown or other
  misc_feature (198)..(198): n is a, c, g, or t
  modified_base (375)..(375): a, c, t, g, unknown or other
  misc_feature (375)..(375): n is a, c, g, or t
tcagtcgcactagtcacgaccggtgctcgatttagtagtgtagatttgggtttggggggaagaggaagactgacggtccccccaggagttcaggtgctgggcacggtgggcatgtgtgagttttgtcacaagatttgggctcaactctcttgtccagtccctggtgcagctgctgcagtcggggactgaggtgaaggngcctgggtcctcggtgagggtctcctgcaaggtcttcgtggaggcaccgttcggcaactatcctatccaccgtgggtgcgacacggcccctggagaaggacttggaggtggggtgggaggcatcactccctcgctttgctaccacccaacctacgcaacagaaacttccaaggcagngtcacgtactttccgctgaacaactacccaacgaacacggcctatcaagactagagacgacgtaccgtagtcgtagacggacgacggacctatttaacgttatggtagtaccaaaggtacactcccaaccgttctaccgtacgggtacggggaaccgaacggggtaaccgacggttacccgaccgttaccgtcccgtaccgaccgtaaccctacccgaacccgtaaaccggggtcccctaacggtttcccgggttacccctttccccccgg

SEQ ID NO: 337604 - DNA, 639 bp, Homo sapiens
  misc_feature: GZ8MTXP02FXB7I.39.25.C03.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctcccagataccattggagaaattgtgatgacgcagtctccagccaccctgtctgtgtctccaggggaaangccaccctntcctgcagggccagtcagagtatcaccagcaacttagcctggtaccacagaaacttggccaggctccaggctccnatctatggtncatccacagggccacgtaggtactccccgaaactaggttcaggtggccctagggtcggggtctcggggaacaggtaaactttcgaaccttctacaaccattcaagcagcctaggcaagttctagtaacgtacgttttaggagtttttatttctggttaccaggtacctaaggttaacttaaaactaaacgttggtccccttacgttcgttccgttagggaacccgtttcgggacccgtaaaagggggaacccctaaaaggttcgggaaaaacttacgaaaaaccggtaacgtaggtcggtactaaggacctaaaccgtattcctcggttacctacttaaccg

SEQ ID NO: 337605 - DNA, 575 bp, Homo sapiens
  misc_feature: GZ8MTXP02G2DQ0.39.25.C03.1.454.CMB.2.raw
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtcgcactagtcacgaccggtgctcgatttagtagtgtagatttgggtttggggggaagaggaagactgacggtccccccaggagttcaggtgctgggcacggtgggcatgtgtgagttttgtcacaagatttgggctcaactctcttgtccagtccctggtgcagctgctgcagtcggggactgaggtgaaggagcctgggtcctcggtgagggtctcctgcaaggcttctgggaggcaccgttcggcaactatcctatcaccgtgggtgcgacaggccctggagaaggactgaggtggggtggaggcatcatcctgcttgctacaccactagcacagaaattcaagcagactcacgattcgntgacatccacgaacncggcctatcagaactgacncacgtacctaagtcgtagacggacaacggctaagtttattactagttacgacaaaggacataccaacctctaccgacgtcgggggaccaacggggtaccgaacgggtccaaccggtcctacctcgacgccctaccgaaccgtaaccgggcctacgtccggtacccttcccccgg

SEQ ID NO: 337606 - DNA, 597 bp, Homo sapiens
  misc_feature: GZ8MTXP02G9EL7.39.25.C03.1.454.CMB.2.raw
  modified_base (496)..(496): a, c, t, g, unknown or other
  misc_feature (496)..(496): n is a, c, g, or t
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgacaggcccctggagaaggacttgaggtggggtgggaggcagtcatccctgctttgctacaccaacctacgcacagaaattccaaggcagagtcacgatttccgctgacgaatccacgaacacggcctatctagaactgagcagccttaaagtctagaggtacacgggacctattttactactgtcgacaacgagactccaccctctacacggtcgggggacctaaagggggacccagggggttccaaccggtctccctacacgccctaccaccgaacggggcccaagtcccggtccttcccctcgggccaccctcctccaaacgcgcaccncgtggggccacgacgtccggccgtggctcgcctggtaccgaaggtacctacgtccacgtacgtcgcgaacgtcggacggcggcgacggacgaacggtccgg

SEQ ID NO: 337607 - DNA, 660 bp, Homo sapiens
  misc_feature: GZ8MTXP02HOMLQ.39.25.C03.1.454.CMB.2.raw
tcagtcgcactagtcacgaccggtgctcgatttagtagtgtagatttgggtttgggggaagaggaagactgacggtccccccaggagttcaggtgctgggcacggtgggcatgtgtgagttttgtcacaagatttgggctcaactctcttgtccagtccctggtgcagctgctgcagtcgggactgaggtgaaggagcctgggtcctcggtgagggtctcctgcaaggcttcgtggaggcaccgttcggacaactatcctatcaccgtgggtgcgacacggccctggaagaaggacttggaggtggggtggaggcatcactccctcgtctttcgaccttaaccaccctaaacctacgaccaacgaacgtaaaacttaccgaaacggacaagtacgtacacgtactttccgctacggaactaaactcccgaaacgaacgaccggcctaactctaaacgaactgaacgtcacgtaccttaaagtccgtaggacgacgaccggtaccttaatttaactttacgtgtacgacaaaggacgtactaccacccgttactaccggtaacgggtcggggaaccgaaacgggaccgtacgggtaccaaccggttcctccgtaccacgtcccgaccgaaccgtaaccggccaccgtccgttccctccccg

SEQ ID NO: 337608 - DNA, 235 bp, Homo sapiens
  misc_feature: GZ8MTXP02G91I7.39.25.C03.1.454.CMB.2.raw
  modified_base (230)..(235): a, c, t, g, unknown or other
  misc_feature (230)..(235): n is a, c, g, or t
tcagtcgcactagtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnnnnn

SEQ ID NO: 337609 - DNA, 563 bp, Homo sapiens
  misc_feature: GZ8MTXP01CUUSA.8.82.H05.1.454.CMB.2.raw
  modified_base (242)..(242): a, c, t, g, unknown or other
  misc_feature (242)..(242): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctctgcaaggcgtccggtanagttcacacgtatggtattagtggtgcgacaggcccctggacaagggcttgagtggatggggtgatcagcgccttacaactattacaacaaactatcgacacagtaacgttcgtagacagagtacacaatcgaccatagacattaccaacggacacagcctatactaggagcgtgacggagcctagacagtcgtagacgtactcgggtcctctatttcgtgtgcgaagaagaagtggggattgggttgggttgggtaccttagtttcgcgttacggtcggggaccgtaacgggtacccgtggttacctaaccgttctcccg

SEQ ID NO: 337610 - DNA, 674 bp, Homo sapiens
  misc_feature: GZ8MTXP01C0LCL.8.82.H05.1.454.CMB.2.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagctcgcgtgtccacgaccggtgctcgatttagtcgagctctctcgcggggacccaaaaaccacaccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaagtctcngcaaggcgtccggtanagttcacaagtatggtattagtgggtgcgacaggcccctggacaagggcttgagtggatggggtgatcagcgccttcaactattacaacaaactatgacacagtaacgttccgtagacagacgtacaccaatagaccatagacatttcacggacacagactatatggagctgcggacgcccgtagacagttcgtacggtaacgtaaccgttccgggacccggttactttaacgttttccgttggttacggtaccgggtaaacggaaaagggtaaaaggttaaggggggtaaagttggggtttaggggggtttacggggttacccgtttaaggttttttacgggttaaccgtttaaccgggttcggggggtaccccggtaacgggggtaaaccccgttcggggttacccgtaaccccggtttccgtttaaccccg

SEQ ID NO: 337611 - DNA, 580 bp, Homo sapiens
  misc_feature: GZ8MTXP02FY87P.8.82.H05.1.454.CMB.2.raw
  modified_base (245)..(245): a, c, t, g, unknown or other
  misc_feature (245)..(245): n is a, c, g, or t
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctccgtgcaaggcgtccggttanagtttcacaacgtatggtattagttgggtgcgacaggcccctggacaaggcttgagtggatggggtgatcagcgccttcaactattacacaaactatgcacagaacgttccgtgaacagagtccaaccntagaacccaataacgactaatttacccaacgggacaacacgcctaatatggagctgcggacnccgtagacatcgagacgactcggaccgtcttatttcgtgtgcgaagaagaaagtggggatgggttagggttgggtaccttagttttacgacgttaacgtggggtaccgaacggggtaacccgtggtaccgtaccggtcctcccg

SEQ ID NO: 337612 - DNA, 552 bp, Homo sapiens
  misc_feature: GZ8MTXP02FPK1C.8.82.H05.1.454.CMB.2.raw
  modified_base (272)..(272): a, c, t, g, unknown or other
  misc_feature (272)..(272): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (455)..(455): a, c, t, g, unknown or other
  misc_feature (455)..(455): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctcctgcaaggcgtccggttacagttcacaacgtatggtattagttggtncgacaggcccctggacaagggcttgagtggatggggtgatcagcgccttcaactattacacaaactatgcacagaacgttccgngacagagtccacntgacatagacatttccacggacacagcctaatatggagctggcggagcctgacagtctcgacgactccgggccgttcctagtttcngttgcgtaagaagaaaagtgggggatggtggggttcggccgttagttttcgacgttaacgtggggaccaagggtaccctgggtaccaccgtctcccg

SEQ ID NO: 337613 - DNA, 774 bp, Homo sapiens
  misc_feature: GZ8MTXP02G2267.8.82.H05.1.454.CMB.2.raw
  modified_base (344)..(344): a, c, t, g, unknown or other
  misc_feature (344)..(344): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagagcccggggcctcagtgaaggtctcctgcaaggcgtccggttacagttcacacgtatggtattagttggtgcgacacggcccctggacgaagggcttgagtggagtggggtgatcgagccgtccttcgaactatacacaaactntgacacgagtaacgttccgtagacagacgtccaacagtcgaacctaatagacctactttaccgaacggaacacacgtaccctaagtaagtggaaacgcgtacggacgggaccgtacccgttaggaacctagttaccgtacgggtaaccgtaccccgttccgggggtacccctttacgtttaacctttttcccggttaagggttcggtaacccgggtaaaaggggtaaaacggttaaaacggggtttacggggggtaaacggtttaggggggtttcggggggttttacgggggtaaccccgttttttaacgggtttttaaccggggttaacccgtttaaaccggggttcgggggtaacccccggtaaaacgggggttacccccggttaacggggttaccccgttaaccccgggttccgtttaaccccccgg

SEQ ID NO: 337614 - DNA, 539 bp, Homo sapiens
  misc_feature: GZ8MTXP02GGJ7M.8.82.H05.1.454.CMB.2.raw
  modified_base (407)..(407): a, c, t, g, unknown or other
  misc_feature (407)..(407): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctcctgcaaggcgtccggttacagttcacaacgtatggtattagttgggtgcgacaggcccctggacaagggcttgagtggatggggtggatcagcgccttcaactattacacaaactatgcaacagaacgttccgtgacagagtcaccatgaaccatagacatttccacggacacagcctatanggagctgcggagcctgacatctgacgactcgggctctattctgtgcgagaagaagtggggatggtgggtggtcttagtttcgacgttacggtcggggaccgaacggggtacccgtggtaccaccgtctcccg

SEQ ID NO: 337615 - DNA, 593 bp, Homo sapiens
  misc_feature: GZ8MTXP02I4DMV.8.82.H05.1.454.CMB.2.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactggaggcgaaggacgcccggggctcgagtgaaggtctcctgcaggcgtcgtanagttcanagtntgtatagtggngcgancggcctggacaggtctgagtggagtggggtgatcgaggcgtccttacgtaaactacttaacaactaaactatcgacaagaagtaaccgttccgtagacgtaagctacacctatcgaaccaatacgactacttaccgaacgacagacgactaatagagagctaggacgcncctanactatcgacgacgtaccgtcgggtaccttcgttcttcgtggtacgaggtaaaagtaagtaaggggtgggcgttaggggtcggggttagtcgtttaagttcggacgttagggcgggtaccgtaacggtaccgcggtccgtaccgtcgtcc

SEQ ID NO: 337616 - DNA, 802 bp, Homo sapiens
  misc_feature: GZ8MTXP02G8OSM.8.82.H05.1.454.CMB.2.raw
  modified_base (401)..(401): a, c, t, g, unknown or other
  misc_feature (401)..(401): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactggaggcgaaggaacggcccggggcctcgaggtgaaggtctccgtgcgaagggtccgttaccggttactagtttccaacgtaacgtagttgggttatttaggttggggtcgaccgacgacgggtccccgtagggacgaaggggtcttaggaggtggaggtgggggtggtactcgaggccgtaccttacgaaacttattaaccaacaaactntcgactaacgagtaaccgtttccgagtacaggtacgtaccacctagtaccgaaactagtaacgaccttaacgttacccgaaacggactacaaccgtctaatacggtagggactacggtcggaccggtaacgtccgtaacggtactaaccgttcggtacggtaaaccgtcccgttacggggtaccctttactttacggtttctaacgggtcggaacggtaaaaggtaaaagggtaaacgggttagggggtacgggtttaggggttacgggggttttacgggtaaccctttttaaggggtttacccggtaaccggttaccgggggttaaccgggggaacccgtaaaccccgggggtttacccgtcccggtttaaacccggtccccgtttacccgtacccccgg

SEQ ID NO: 337617 - DNA, 683 bp, Homo sapiens
  misc_feature: GZ8MTXP02GAZ5Z.8.82.H05.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagacggcccgggctcagtgaaggtctccngcaggcgtccgttanagttcacagtatgtattaggtggngngacnggccctggacgaggcttggagtggagtggggtgatcgaggcgtccttacgaaactagttaaccaactaaactatacgacaacgaggtaacgttccgagaacaggtacgtaccaacagtacgaactaagtacgtactacgtttaccgaacggaaccaacacgtacctaatagtagggacgtcgtacggacggacgtcccgttagaactactacgtcggaaccgtaccgtccggtccttacgtttacgtttcgtggtacgtacgggaaagtaaaagggtaaaggttagggggtagtttgggggtttacgggggtttagggtacccgttttaaggtttcgtaacggtttacggggtcgggggaaccggtaccgggggtaacccgttcgggtacccgtacccgttccgttacccg

SEQ ID NO: 337618 - DNA, 750 bp, Homo sapiens
  misc_feature: GZ8MTXP02JS8JC.8.82.H05.1.454.CMB.2.raw
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggacgaagaacggcccggggctcgagtgaaggtcctcctgacgaaggtcgtccggttatagttcaactacgtatggtattaggttggngcgacaggcccctaggaacaaggctgaggtggagtggggtgagtcgacgcgccttacaaacttataacaaaccaaagttanacgacaaacgtagtaaaccgtttccgagtaacacggaactacctaacagttcgaaaccgtaatacgtaactacttaccgaaacggacacgacgtcctaaagtacgtagggaacgtccggtacggaccgacgtaccgtacgaactacgttaccggtacggtaaccggtacccggttccgggttaacccgttacgtttacgtttcggtacggtaacggaaaggtaaaacggaaaaggttaaaagggggttcggggtaggtttagggggtttaccgggggtttacggttaaccgttttaacgtttacggtaaccggtaccggggtaaccgggggtacccggtaaaacggggtaacccgttacggtaccccgtaacccgtttccgtaacccg

SEQ ID NO: 337619 - DNA, 323 bp, Homo sapiens
  misc_feature: GZ8MTXP01DWHGG.21.71.G05.1.454.CMB.2.raw
  modified_base (315)..(315): a, c, t, g, unknown or other
  misc_feature (315)..(315): n is a, c, g, or t
  modified_base (320)..(323): a, c, t, g, unknown or other
  misc_feature (320)..(323): n is a, c, g, or t
tcagtcgtcgctcgcacgaccggtgctcgatttagtgtcgtcgcaagagagaggggggtgaggtgaaagatgagctggaggaccgcaataggggtaggtcccagacagaatcagcggctttgggtcaggctctgatttcacactgaacatcagcagggtggaggctgacgatgttggctattttatttttgcatgacaaaatacagactggccttggacgttcggcctgggaccaggttgaaatcaaagactgtggctgcacatctgtctcatctcccgcatctgacgagcgacgactgagcggctggcaaggcnatagnnnn

SEQ ID NO: 337620 - DNA, 333 bp, Homo sapiens
  misc_feature: GZ8MTXP01DIC87.21.71.G05.1.454.CMB.2.raw
  modified_base (328)..(333): a, c, t, g, unknown or other
  misc_feature (328)..(333): n is a, c, g, or t
tcagtcgtcgctcgcacgaccggtgctcgatttagtgtcgtcgcaagagagagggggtgaggtgaaagatgagctggaggaccgcaataggggtaggtcccagacagaatcagcggctttgggtcaggctctgatttcacactgaacatcagcagggtggaggctgacgatgttggctattttatttttgcatgcaaaatacagactggccttggacgttcggcctggggaccaggttgaaatcaaacgaactgtggctgcacatctgtcttcatcttcccgcatctgacgagcgaacgactgagcgggctggcaaaggcgacatagnnnnnn

SEQ ID NO: 337621 - DNA, 260 bp, Homo sapiens
  misc_feature: GZ8MTXP01AJ6EH.21.71.G05.1.454.CMB.2.raw
  modified_base (257)..(260): a, c, t, g, unknown or other
  misc_feature (257)..(260): n is a, c, g, or t
tcagtcgtcgctcgcacgaccggtgctcgatttagtgtcgtcgcaagagagaggggtcaggctctgatttcacactgaacatcagcagggtggaggctgacgatgttggcattttatttttgcatgcaaaatacagactggccttggacgttcggcctggggaccaggttggaaatcaaacgactgtggctgcaccatctgtcttcatcttcccgcatctacgagcgacgactgagcgggctggcaaggcgcatagnnnn

SEQ ID NO: 337622 - DNA, 610 bp, Homo sapiens
  misc_feature: GZ8MTXP01DPS9F.25.56.F01.1.454.CMB.2.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctggtgggaanacagatcactatctacgtcgggccgggngagtacagactaacttaactaattattacgctagtactacaaacaacgaaacgaaggtaaactacctaagctactagtatactattctgactactcctactcgaccgtacgtacgacggtcctactccgtcgtcttacgacggtccggacgtagggtggtacgtcggtacggtacgtaagttacttacgacgttcctaccgtacctacgtacccgaccggtcctcgtacgtacgtaccggtacgtacgtacttacgttacgtactaacttaacttaactaacgtaactaaactaactactaactacgttacgtaccgttacgttacgttcgttacgacggacgaacgtacgtaacgacgtacgaacgtaacgttgtg

SEQ ID NO: 337623 - DNA, 538 bp, Homo sapiens
  misc_feature: GZ8MTXP01DOF6N.25.56.F01.1.454.CMB.2.raw
  modified_base (204)..(204): a, c, t, g, unknown or other
  misc_feature (204)..(204): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagactgtacagtcacgaccggtgctcgatttagcagacgtctgaacacacgaagggggcagcagtctctctcagtcaggacacagcatggacatgagggtccctgctcagctcctgggactcctgctgctctggctcccaggtaccagctgtgacatccagatgacccagtcctccttccttcctgtctgcatctgtggganacagatcaccatcacttggccgggcgagtcaggacattaaccaattattagctgtatcaacacaaaccaaggaaactcctaagcctcctagactctattctgctactcctacctgccagtcgacggggtcccagtcctcgcttcacgcgcgagtggatcgtgggacagtatttcagtctacaccatccaccggctgcagccgtgacgtatctgactaacttattactntaacaaaactntcaactacgttcgtaccccgttagtacggtttcggaccgttacggggacccaacggtacgtcggtaaccgtacgaaaacggtaacgttcggtcgg

SEQ ID NO: 337624 - DNA, 520 bp, Homo sapiens
  misc_feature: GZ8MTXP01E2GD9.25.56.F01.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttggccgggngagtcaggacattaccaattattagcctggtatcaacacaaaccaggaaagtccctaaagctcctgatctattctgcatccaccttgccagtcaggggtcccatcctcgcttccagcggcagtgggatcgtgggacaggatttcagtctcaccatcacggcctgcagctgacgatcttgcaacttattactatacaaaacctatcaactagttcgccccgttaactagttttacggcccgttaagggggacccaacaggttcggaccttacgaaagtaaccgttgtaacgg

SEQ ID NO: 337625 - DNA, 524 bp, Homo sapiens
  misc_feature: GZ8MTXP01AIYA9.25.56.F01.1.454.CMB.2.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttctgtctgcatctggtggagacagagtcaccatcacttggccgggngagtcaggacattaccaattatttagcctggtatcaacacaaaccagggaaactcctaagctcctgatctattctnctactacctacttgccacgtcgacgggtcccatctcgtctcagcgcgaggtgctcgtagggactaggtacttcagttctacaccactccgaccggtccncgcncgtcgtagacgtctcgtacacttacttatactactaactaaactcacaactcgttccgtaccgttagttacggttcggacggacggacaacgtagtaacgactagacgtcgttcgtg

SEQ ID NO: 337626 - DNA, 626 bp, Homo sapiens
  misc_feature: GZ8MTXP01C569S.25.56.F01.1.454.CMB.2.raw
tcagactgtacagtcacgaccggtgctcgatttagcagacgtctgtcgggggtgagggtttagaacctatgaacattctgtagggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccaggcgagagggtcaccatctctgcacgtgggacagttccaatagtcgggcaccttataatgtcactgtatcaactaactccaggacacgccccaaactccgtcattcatgactagaactaaacaactccgtccctcgacggtcgtaccctcgaccgtactttccgtccggtccttacccgaaagttccgttcggcctacccgttcacgtccccttccccgttgggggtaccacttccacgttcgggcccttacccgagtaaccgttgaacgggtactagggtaaacgggttgtaacgtttaacctaacgttcggtaccctacggttacccgttattacggaaccaaacgtcgtccggttcggttccgggtttgggttttcgggtttcccggg

SEQ ID NO: 337627 - DNA, 501 bp, Homo sapiens
  misc_feature: GZ8MTXP01BA137.25.56.F01.1.454.CMB.2.raw
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccaggcgagagggtcaccatctcctgcactggggacagttccaatatcgggcaccttataatgttcactggtatcaacaacttccaggacacgcccccaaactccgtcattcatgctgaataacaatcgtccctcaggtgtccctgaccgattctccggctccaagtctggcacctcacgcctccctggggtcatcacgtggctcngactgagntgaagtgattactacttgccagttccttnttcgaacacngcctgcgtggttgtcg

SEQ ID NO: 337628 - DNA, 506 bp, Homo sapiens
  misc_feature: GZ8MTXP01ELAF3.25.56.F01.1.454.CMB.2.raw
  modified_base (201)..(201): a, c, t, g, unknown or other
  misc_feature (201)..(201): n is a, c, g, or t
  modified_base (432)..(432): a, c, t, g, unknown or other
  misc_feature (432)..(432): n is a, c, g, or t
tcagactgtacagtcacgaccggtgctcgatttagcagacgtctgaacacacaaaggggcagcagtctctctcagtcaggacacagcatggacatgagggtccctgctcagctcctgggactcctgctgctctggctcccaggtaccagctgtgacatccagatgacccagtctccttccttccttctgcatctgtggganacagagtcaccatcacttgccgggcgagtcaggacattaccaatattagcctggtatcaaacacaaaccagggaaagtccctaaagctcctgatctatctgcatccacttgcacgtcaggggtcccatctcgcttcagcggcagtggatcgtgggacagtatttcagtctcaccatcaccggctgcagcctgacgatcttgcaacttatactatacaaatatcacaagtcncccgtacttagtttcggcaggggttaccacaaggttacggaaccttaccgaaaggttaacctggttcgggtccg

SEQ ID NO: 337629 - DNA, 541 bp, Homo sapiens
  misc_feature: GZ8MTXP01BU0MW.25.56.F01.1.454.CMB.2.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (420)..(420): a, c, t, g, unknown or other
  misc_feature (420)..(420): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcttcctgtctgcatctgtggganacagatcaccatcattggccgggngagtcaggacattaccaattattagcctaggtatcaaacacaaaccaggaaatccctaagcctctagatctattctgcactccacttgccagtcacggggtcccatcctccgtcttcaggccggctaggtggatcgtaggacaggtattcagtctacacatccgaccgctcgcacgcgtacgacgtatcgttanacctaaactttattaacctataacctaaaacttctacaactacgttccgtacccgttagtacggtttcgaccgacggggacctaacgagtaacgacctaggaacgtaacgttggtaaccgg

SEQ ID NO: 337630 - DNA, 592 bp, Homo sapiens
  misc_feature: GZ8MTXP01A7MRZ.25.56.F01.1.454.CMB.2.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatcgacccagtcctccttccttcctgtctgcatctgtggganacagatcaccatcacttggccgggngagtcaggacattaccaattattagcctgtactacaaacacaaaccgaggaaacgtccctaagctcctagatctattctgcctactccaccttgcccaggtcgacggggtcccatctcgtcttcgacggcggcacgttggacttcgtaggggactaggtaactttcgaacgttccttaccaccctaacgttcccgacccgggtccttcggccaacgtcccggtcgtaaccgtattccgttacactaaacctttattactatacaaaaccttctacaactcgttccgtaccccgttagttaggtttcggaccgacggggaccaacgtacgtcggaacccgtagaacggtaacgttgtaaccgg

SEQ ID NO: 337631 - DNA, 540 bp, Homo sapiens
  misc_feature: GZ8MTXP01EKBM7.25.56.F01.1.454.CMB.2.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcacatcacttggccgggngagtcaggacattaccaattattagctgtatacaacacaaacaggaaactcctaagctctgatctatttctgctactccaccttgaccagtcgacggggtcccatcctcgtcttcgagcgcagtggatcgtggacagtnttcagtctacacctatccaccggcctgcacgccgtgacgtattcttagacctaactttattactntaacctaaactactctaactcgttaccgtaccccgttagtacgtttcggaccgttacggggaccctaacgtaggtaacggacctaggaaacggtaacgttggtaacgg

SEQ ID NO: 337632 - DNA, 531 bp, Homo sapiens
  misc_feature: GZ8MTXP01DYJ0J.25.56.F01.1.454.CMB.2.raw
  modified_base (395)..(395): a, c, t, g, unknown or other
  misc_feature (395)..(395): n is a, c, g, or t
  modified_base (461)..(461): a, c, t, g, unknown or other
  misc_feature (461)..(461): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccaggcgagacgggtcaccatctcctgcacgtggggacagttccaatatcgggcaccttataatgttcactgtatcaacaacttcaggacacgccccaaactccgtcattcatgactgaataacaactccgtccctcacggtcgtccctgaccgtacttcnccggctccaagtctgccacctcacgcctcctgggtcatcacgtggctccagactgagatgaaggtntattactacttgacctagttcccttnttacgaacaaacgngccctggttccgttggtttcggttcccggg

SEQ ID NO: 337633 - DNA, 557 bp, Homo sapiens
  misc_feature: GZ8MTXP01AOBPN.25.56.F01.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (407)..(407): a, c, t, g, unknown or other
  misc_feature (407)..(407): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtcctccttccttctgtctgcatctgtggganacagagtcacatcacttggccggngagtcaggacattacaattattagcctgtatacaacacaaaccaggaaactccctaagctctgatctattctgctactccacttcgccagtcgacggggtcccatcctcgtcttcacggcggtcaggtgagtcgagggacaggtactttacgagtcctcaccactaccgaccgggtcccncgccgacgccggtacgtacgtacttacgttacgtacttaactttaacttactacgtaactaaactactacaactacgttcgtacccgttagttacggttcggaccgcgggacctaacgacggtaacgactacgaacgtaacgttcggtcg

SEQ ID NO: 337634 - DNA, 619 bp, Homo sapiens
  misc_feature: GZ8MTXP01DHF11.25.56.F01.1.454.CMB.2.raw
  modified_base (539)..(539): a, c, t, g, unknown or other
  misc_feature (539)..(539): n is a, c, g, or t
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcgggggccccaggcgagacgggtcaccatctctgcacgtggggacagttccaatagtcgggctaccttataatgttcactgtatcaacacttccaggacacgcccccaaactcccgtacattcatgactagaactaaacaatccgtcccctcgacggtcgtcccctagaccgtacttcgtacccggtccttacccgaagttcctacggccctaaccttccgaccgtccccttccccgttggggttaccctacgttacctaccgtcggggtccctaccgacggtacgttggacggtagtacggtaagggtntaacgtttaccgtacgcgtacctacgttaccttagttacgaactaactcttccgtggttcggtttgggtttcgttccggg

SEQ ID NO: 337635 - DNA, 540 bp, Homo sapiens
  misc_feature: GZ8MTXP01END73.25.56.F01.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (334)..(334): a, c, t, g, unknown or other
  misc_feature (334)..(334): n is a, c, g, or t
  modified_base (422)..(422): a, c, t, g, unknown or other
  misc_feature (422)..(422): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcttcctgtctgcatctgtggganacagagtcaccatcacttgccgggngagtcaggacattaccaattattagcctgtatcaaacacaaacaggaaagtccctaagctcctgatctattctgcatccacttgccagtcacggggtcccatcctcncttcagcggctaggtggatcgtgggacagtatttcagtctcaccatcaccgcctagcagccgtgacgactcttgactaattattactntaaccaaacttctccaatacgttacggtccccgttaacgtacggttttacgggcccgacggggacccaacgtaggtccgggtaaccccttagaaaacgggtaaccgttaaggtccggg

SEQ ID NO: 337636 - DNA, 583 bp, Homo sapiens
  misc_feature: GZ8MTXP01AV7OX.25.56.F01.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (488)..(488): a, c, t, g, unknown or other
  misc_feature (488)..(488): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatcgacccagtccttcccttccttcctgtctgcatcgtggtggganacaggatcaccatccacgttggccgggngagtcaggacattaaccaattattagctgtatacaacacaaacaggaaactccctaagctcngtatctattcngctactccacttgccctacgtcgacggggtcccatcctcgtcttcgagtcggctagtggactcggtaggacctaggtactttacgacgttctaccacctaccttcccgacccggtcctacgcctacgccggttgaccgtattcttacgacttaactttagttactatacctaaaactntcaactcgttccgtacccgttgttacgttcggaccgttacggggttacccaacgtacggtaacggtaaccctaggaaacggtcgttaacggtcgg

SEQ ID NO: 337637 - DNA, 517 bp, Homo sapiens
  misc_feature: GZ8MTXP01BU43Y.25.56.F01.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtcctccttcctcctgtctgcatctgtggganacagatcaccatcattggccgggngagtcaggacattaccaattattagcctggtatcaacacaacaggaaagtccctaagctctgatctattctgcatccaccttgccagtcaggggtcccatctcgcttcagcgcagtgatcgtggganagtattcagtctacaccatcaccggctgcacgcgtgacgtatcttgactaacttattactntacaaactntcaactagttcgtccccgttagttacggtttcggaccgttacggggacccaagtaaggtcggtacctaccgaaaggtaaccgttaaggtccgg

SEQ ID NO: 337638 - DNA, 540 bp, Homo sapiens
  misc_feature: GZ8MTXP01AUQD0.25.56.F01.1.454.CMB.2.raw
  modified_base (376)..(376): a, c, t, g, unknown or other
  misc_feature (376)..(376): n is a, c, g, or t
  modified_base (513)..(513): a, c, t, g, unknown or other
  misc_feature (513)..(513): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacaggtcctgggcccagtctgtactgacgcagccgccctcagtgtctggggcccccaggcgagagggtcaccatctcctgcacgtggggacagttccaatagtcgggcaccgttataatgttcactggtatcaacaacttccgaggacacgacccccaaactcccgtacattcatgactgaataacaactcgtccctnaggtctccctagaccgtattcctcccggctccaagtctcggccaccttcacgccctcccgtggggtcatccacgtcggcctaccgagactgagatgaagtgaattactacttcgacctgttccttattcgaacaacngcccgtgttcggttcggtttggtccgg

SEQ ID NO: 337639 - DNA, 592 bp, Homo sapiens
  misc_feature: GZ8MTXP01EYDL2.25.56.F01.1.454.CMB.2.raw
  modified_base (465)..(465): a, c, t, g, unknown or other
  misc_feature (465)..(465): n is a, c, g, or t
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactctcctcgctcactgcacgaggtcctgggcccagtctgtactgacgcacgccgcctcagtgtcgtcggggccccaggcgagacggtcaccatctctgcacgtggggacagttaccaagtacgtcggggactaccgttataactgttacacgtggtactacaaacctaacttaccgaggtaccacgaccccctaaactcccgtactaattcatcgaactacgaactaaactaactccgtccctacgtacgtcgtaccctacgtaccgtactccgtccgcctacgtaacgtctcgccactcccncctccgtccgtcgtctctacgtacgtcgtcgtcgacgacgagtagtagtagtagtaagtacttactacttcgtacgtacttacgttcttacgaacacgtcgtcgtcgttcggttcgggttcggtcgg

SEQ ID NO: 337640 - DNA, 532 bp, Homo sapiens
  misc_feature: GZ8MTXP01BHMUG.25.56.F01.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcttcctgtctgcatctgtggganacagagtcaccatcacttgccgggngagtcaggacattaccaattattagcctggtatcaacacaaacaggaaactcctaagctcctgactctattctgcatccacctgccagtcaggggtcccatccncgcttcagcgcagtggatcgtgggacngtattcagtctcacctatccaccggctgcacggctgacgctctgctacttatacctntaccaaacttagtcaactcgttcgtaccccgttagtacggttttacggcccggacggggaaccctaacggacggtaacggtaacccgtacgaaaacggtaaccgtttggtaaccggg

SEQ ID NO: 337641 - DNA, 627 bp, Homo sapiens
  misc_feature: GZ8MTXP01BHTQU.25.56.F01.1.454.CMB.2.raw
  modified_base (312)..(312): a, c, t, g, unknown or other
  misc_feature (312)..(312): n is a, c, g, or t
  modified_base (378)..(378): a, c, t, g, unknown or other
  misc_feature (378)..(378): n is a, c, g, or t
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtcgtgggggccccagggcgagacgggtcaccatctcctgcactggggacagttccaatagtcgggcaccttataatgttcactgtancaacacttccaggacacgcccccaatcccgtcattcatgactagaactaaacaactccgtaccctnacggtcgtccctagaccgtattcctccggctccaacgtctcggccacctctacgtcccttccccgtcggggtcaacttcccgaacgttcggggcccttccgaacgtaccgtaggagggtacgtacggaaagggttgtaaactttaccgtaaccgttcggtaaccctacggttacccttagttaccggtaaaccaacgtaaccggtccccgttgggttccgggtttcggggttttcgggtttccccgggg

SEQ ID NO: 337642 - DNA, 606 bp, Homo sapiens
  misc_feature: GZ8MTXP01CHOOC.25.56.F01.1.454.CMB.2.raw
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgaccgcacgccgcctcagtgtcgtcggggccccaggcgagtacgggtcaccgatctcctgcacgtgggacagttccaatacgtcgggacaccttataatgtcactggtatacaacaacttccgaaggaccacgacccccaaactcccgtactattccatgaacctagaactaaacaaactccgtacccctcgacggttctccctacgaccgtacttcgtccggaccttcgaacgttcagccctaccgctaccgtcctacccgtggggtccacttccacgtcggctcccgagaccgttgagagtagtaacgggtaataacttacgttaacttcggtaccctgttacccttgttaaccgaacgacgtaacgtcccgtggttccgttgggtttcgggttcccgg

SEQ ID NO: 337643 - DNA, 656 bp, Homo sapiens
  misc_feature: GZ8MTXP01AWNQC.25.56.F01.1.454.CMB.2.raw
  modified_base (222)..(222): a, c, t, g, unknown or other
  misc_feature (222)..(222): n is a, c, g, or t
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactctcctcgctcactgcacgagggtcctgggcccagtctgtactgacgcagcccgccctnagtgtcgtacggggccccaggcgagacgggtcaccatctcctgcacgtgggacagttccaatcgtcgggctaccgttataatgttacactaggtatcaaactaaccttccgaggaccacgacccccaaactccgtacattcatgactagaactaacactccgtccctgacgtcgtccctaggacctacttccgtccggtactacccgtaaacggttcctcggacccaacccgttccgtaccgtcccgttcccgtccgggtacgtacgtaccgtaccgtccggtccgtaccgtacgtacgtacggtaacggtaacggtaacggtaaggttaacgttaacgttaaccgttacgttaccgtaccgtacgttaccgttacgttacgtaaccgtaacgtaacgtcggttcggttcgggtttcgggtttcgggttccggg

SEQ ID NO: 337644 - DNA, 701 bp, Homo sapiens
  misc_feature: GZ8MTXP01C85H2.25.56.F01.1.454.CMB.2.raw
  modified_base (208)..(208): a, c, t, g, unknown or other
  misc_feature (208)..(208): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggcctcccaggtaccagctgtgacatccagatcgacccagtcctccttccttcctgtctgctatcgtgtggganacagacgtcaccatcacgttcggccgggacagtcaggactacttaaccaatttagttcgccttaggtactacaacaacaaacgaaggaaacgtccctaagcctacgtagtactctattctgactactccgtacttgccctacggtcgaccgggtcctagtccctcgtcgttacgcggacggtcagggttggactcgtagggtacaggttacttcacgttaccacgacctacgtccgacccggtctacgacgtaccgaccgtacgggacgttaacgttccgttacgtaacccttaaactttaacgtttaaccgtacgtttaaaaacccaaacgtttaacctaccgtaaaccgttaaccggttacccggtaacccccgtttaacggtttaccgggttttaaccccgggaacgggttaaccggggaaacccctaacgggtaacggtaaccggtaaacccggttaaacaaacggggttaacccgttggtaacccggg

SEQ ID NO: 337645 - DNA, 548 bp, Homo sapiens
  misc_feature: GZ8MTXP02GTL1P.25.56.F01.1.454.CMB.2.raw
  modified_base (204)..(204): a, c, t, g, unknown or other
  misc_feature (204)..(204): n is a, c, g, or t
  modified_base (419)..(419): a, c, t, g, unknown or other
  misc_feature (419)..(419): n is a, c, g, or t
tcagactgtacagtcacgaccggtgctcgatttagcagacgtctgaacacacaaagggggcagcagtctctctcagtcaggacacagcatggacatgacgggtccctgctcagctcctgggactcctgctgctctggctcccaggtaccagctgtgacatccagatgacccagtctccttccttcctgtctgcatctgtggganacagatcaccatcacttggccgggcgagtcaggacattaccaattattagcctggtatacaacaacaaaccgagggaaacgtccctaagctacctgactctattctgctaatcccaccttgccctagtcgacggggtcccatcctcgcttcagcgcagtggatcgtgggactagtattcagtctacaccatccgaccggctgcacgccctggacnttctcactaacttatactataactaaaactatacaactacgtaccgtaccccgtactacggtttcgaccgtacggggaccaacgtacggtaccggtaccgtaacgaaaacggtaacgtttaggtaccgg

SEQ ID NO: 337646 - DNA, 513 bp, Homo sapiens
  misc_feature: GZ8MTXP02IEB5W.25.56.F01.1.454.CMB.2.raw
  modified_base (203)..(203): a, c, t, g, unknown or other
  misc_feature (203)..(203): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttggccgggcgagtcaggacattaccaatattagcctggtatcaacacaaaccaggaaacgtcctaagctcctgatctattctgcatccactgccagtcagggtccatcagcttcagcggcagtggatctggacagattcagtctcacatcaccgcctgcagcctgacgactcttcgctaacttattactacttacaaaactatactacacgtacgtcccgtacgtacgttttacggaccgtacgggaaccgaacgtacgtacgggtacctacgaaacggtaaacctaggtcgg

SEQ ID NO: 337647 - DNA, 484 bp, Homo sapiens
  misc_feature: GZ8MTXP02ICTYK.25.56.F01.1.454.CMB.2.raw
  modified_base (212)..(212): a, c, t, g, unknown or other
  misc_feature (212)..(212): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagactgtacagtcacgaccggtgctcgatttagcagacgtctgtcggggtgagggtttagaacctatgaacattctgtagggctctgcttcagctgtgggcacaagaggcagcactcaggacaatctccagcatggcctggtctcctctcctcctcactctcctcgctcactgcacagggtcctgggcccagtctgtactgacgcagccnccctcagtgtctggggccccaggcgagagggtcaccatctcctgcactggggacagttccaatatcggggcaccttataatgtcactggtatcaacacttcaggacacgccccaactccgtcattcatgctgataacaatcgtaccctcgagctccctcgaccgattctccgctccagtctgcacctcagcctcctgcatcactcggctccagactgagntagaagtgattcactgaccngtcctancaacacacgctgtcgtcgttcgtcg

SEQ ID NO: 337648 - DNA, 534 bp, Homo sapiens
  misc_feature: GZ8MTXP02H3PRS.25.56.F01.1.454.CMB.2.raw
  modified_base (203)..(203): a, c, t, g, unknown or other
  misc_feature (203)..(203): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttggccggcgagtcaggacataccaattattagcctggtatcaacacaaaccaggaaagtcctaagctcctgatctattctgcatccaccttgccagtcacggggtcccatctcgcttcagcgcacgtgatcgtggacagtattcagtctacaccatcaccggctagcacgcctgacgatctgactaacttattactatactaaaactactacaacacgttaccggtacccctacgtacgtttttacgggacccgtaacggggtaaccaaccgtaacggtacggtaccgttaacgaaaacggtaccgtaggtcgg

SEQ ID NO: 337649 - DNA, 522 bp, Homo sapiens
  misc_feature: GZ8MTXP02HLVJ6.25.56.F01.1.454.CMB.2.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (410)..(410): a, c, t, g, unknown or other
  misc_feature (410)..(410): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctttctgcatctgtggganacagagtcaccatcacttgccgggnagtcaggacattaccaattattagcctggtatcaacacaaaccagggaaacgtccctaagctcctgatctattctgcatccaccttgcagtcaggggtcccatctcgcttcacgtcggcagtggatcgtgggacagtattcagtctcaccatcaccggctcgcacgcctagacgtatcgttnacctaacttattactatacaaaactactcaacacgtacgccccgtactacggttttacgccgacggggtaccacgaaggtcgaccttacgaaacggtaacctggttacgccg

SEQ ID NO: 337650 - DNA, 513 bp, Homo sapiens
  misc_feature: GZ8MTXP02HDZXT.25.56.F01.1.454.CMB.2.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggcgagtcaggacattaccaattattagcctggtatcaacacaaaccaggaaagtccctaagctacctgatctatctgcatccacttnccagtcaggggtccatctcgcttcagtcgcagtggatcgtgggacagtattcagtctcacatcaccggctgcagcctagacgatctgactaacttatactagtacaaactatacaactacgtcgtaccccgtatacggtttcggaccgtaacggggtaccaacgacggtacggaacctacgaaacggtaaccgtagtcgg

SEQ ID NO: 337651 - DNA, 538 bp, Homo sapiens
  misc_feature: GZ8MTXP02HYJYD.25.56.F01.1.454.CMB.2.raw
  modified_base (368)..(368): a, c, t, g, unknown or other
  misc_feature (368)..(368): n is a, c, g, or t
  modified_base (497)..(497): a, c, t, g, unknown or other
  misc_feature (497)..(497): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccaggcgagagggtcaccatctcctgcactggggacagtccaatatcgggcaccttataatgttcactggtatcaacaacttccaggacacgacccccaaactccgtcattcatgcttgataacaatccgtccctnacggtcgtccctgaccgattcctcggcctcctaagtcctggcacctcacgcctcccgtcgtcattcacgtggcctccagtactgaggataggaagtgtaatttactactcggacctacgtacccttaanacgaacgaacgacgtccgtcggtcggtttcggtttcggtcg

SEQ ID NO: 337652 - DNA, 509 bp, Homo sapiens
  misc_feature: GZ8MTXP02JZURO.25.56.F01.1.454.CMB.2.raw
  modified_base (352)..(352): a, c, t, g, unknown or other
  misc_feature (352)..(352): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacaggtcctggcccagtctgtactgacgcagccgccctcagtgtcgtggggccccaggcgagagggtcaccatctcctgcactggggacagttccaatatcggggcaccttataatgtcactggtatcaacaacttccagggacacgcccccaaactccgtcattcatgcttgntaacaatccgtcctcaggtctccctgaccgtattcctccggctccagtctggccacctcacgccctcctgtcatcactggctccgagactgagatagaagtgattacactgcctagtcctatcgaacaaacctgcctgccggttggtttcggtccgg

SEQ ID NO: 337653 - DNA, 732 bp, Homo sapiens
  misc_feature: GZ8MTXP02HOHDA.25.56.F01.1.454.CMB.2.raw
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtacctgacgcacgcccgccctcagtgtcgtcggggccccaggcgaggacgggtcaccatcctcctgcacgtggggacagtccaatagtcggggcaccttataatgttcacgtggtatacaaactaacttccgaagggaccaccgaccccctaaactcccgtactacttcatcgctagactaaacaacttccgtaccctcgtaacggtccgttccctagtacccgtactttcccgtcccgggtccctacccgtaaacgtccgttaacggccctaacccccgttccgaaccggtccccctttcccgtacgggttcctacgttacccgaaccggtttccggggcccttaccggaaacggtacccgttacgggaaacggtaacgttaacgggtaaaaggggttcgttaaaacttttaccggtaaacctccgggtaaccctaacggttacccctttaaagtacggaaaacccccttaaagaacccggtcccgtttgggttccgggtttacggggtttttaccggggttccccggggg

SEQ ID NO: 337654 - DNA, 527 bp, Homo sapiens
  misc_feature: GZ8MTXP02G7K3Z.25.56.F01.1.454.CMB.2.raw
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggcgagtcaggacattaccaattattagcctggtatcaacacaaaccaggaaagtccctaagctcctgatctatctgcatccacttgccagtcaggggtccatctcgcttcagcgcagtgatcgtgggacagattcagtctcaccatcacgctgcagcctgacgatcttgcacttattactagtacaaaactatacactacgtacgccccgttaacacggtttttacggacccgttaacgggggaacccaacgtacggttacggaacccgttacgaaaacggtaaccgtaaggtttaccggg

SEQ ID NO: 337655 - DNA, 535 bp, Homo sapiens
  misc_feature: GZ8MTXP02IYIWW.25.56.F01.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcttcctgtctgcatctgtggganacagagtcaccatcacttgccgggngagtcaggacattaccaattattagcctggtatcaacacaacaggaaatccctaagctcctgatctattctgcatccacttgccagtcagggtcccatctcncttnagcgcagtggatctggacagattcagtctcaccntcaccgctgcacgcctgacgactcttcgacctaacttattactacgtactaaaacttatacaactagttaccgtaccccgttaacgtacggtttttacggacccgtacgggggaaccctaacgacggttacggtaacccgtacgaaaacggtacgttacggtaaccgg

SEQ ID NO: 337656 - DNA, 521 bp, Homo sapiens
  misc_feature: GZ8MTXP02JW9J2.25.56.F01.1.454.CMB.2.raw
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (390)..(390): a, c, t, g, unknown or other
  misc_feature (390)..(390): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttccngtctgcatctgtggganacagagtcaccatcacttggccgggngagtcaggacattaccaattattagcctggtatcaacacaaaccaggaaagtccctaagctcctgatctattctgcatccacttgccagtcacggggtccatctcgcttcagcgcagtgatctgggacagtatttcgatctcaccatcaccggctcgcacnctcgacgactcttcactaacttacttactactactaaactaactactactaacgtcgtacccgtaccgtacgtttacgtaccgacgggaccgaacgacgtacggacgtacgaaacggtaaacgtacgtcgg

SEQ ID NO: 337657 - DNA, 550 bp, Homo sapiens
  misc_feature: GZ8MTXP02IJSM4.25.56.F01.1.454.CMB.2.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcttcctgtctgcatctgtggganacagngtcacatcacttggccggggngagcagactatactaattattanctagtacacaacaacaacgaggaacgtacctanctctntactctatcncnctactcctactcncctacgtcgacggtcctactcctcgtctcgacggcgcgtaggtgacgtcgtaggactagttacttacacgtctaccacctacgtaccgaccgtcctcgcacgacgtcgtacgtactactacgtactaacttacttactactaactaaactactactacgtacgtacgtaccgtacgttacgttacgtacggtacggacgtaacgtacgtacgtacgtaacgaacgtacgtacgtcg

SEQ ID NO: 337658 - DNA, 669 bp, Homo sapiens
  misc_feature: GZ8MTXP02JPF9K.25.56.F01.1.454.CMB.2.raw
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctcggggccccaggcgagacgggtcaccatctcctgcacgtggggacagttccaatatcgggcaccttataatgtcactgtatcaacacttcaggacacgaccccaatccgtcattcatgcttagactaaacaactccgtaccctcgtacggtcgtcccctagtacccgtactttccgtcccggtccttacccgaaagttccgtacgggtccctaacccttcgaaccgtcccccttccccgttgggtaccctaacttccgaaccggttcggggcccttacccgaaggtacccgttggaacgggtacgttagggaaacgggtttacggtaaacgttttaaacctaccgtttccggaccctaacggtttaccccgttaattacggaaaccaaaaccgtacggtccccgttaggtacccgggtttacggggtttacgggtttccccggg

SEQ ID NO: 337659 - DNA, 576 bp, Homo sapiens
  misc_feature: GZ8MTXP02IUES5.25.56.F01.1.454.CMB.2.raw
  modified_base (400)..(400): a, c, t, g, unknown or other
  misc_feature (400)..(400): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtctcggggccccaggcgagagggtcaccatctcctgcacgtggggacagttcccaatacgtcggggcaccttataatgttcactggtatcaactacttccgagggacacgaccccaaactccgtacattcatcgctgataacactccgtccctcgaggtcgtccctgacctattcnccggctccaagtctcggcctacctcacgtccctcccttggtctacttccacgttcgggcccttccgacgacgtaggaggataggaacgttggtactttactaacgttcgacctacgtaccttaacgtacgtaacaaactacggtacctcggtcgtttcgggtttcggtttcccggg

SEQ ID NO: 337660 - DNA, 518 bp, Homo sapiens
  misc_feature: GZ8MTXP02G87RU.25.56.F01.1.454.CMB.2.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (428)..(428): a, c, t, g, unknown or other
  misc_feature (428)..(428): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggcgagtcaggacattaccaattattagcctgtatcaacacaaacaggaaatcctaagctcctgatctattctgcatccacttnccagtcagggtccatcctcgcttcagcgcagtggatcgtgggacagtattcagtctcaccatcaccggcctgctacgcctgacgatcttagactaacttacttactagtacaaaactanacctaacacgttcgaccccgttacgtacgtttcggaccgtacggggtaccaacgtacggtacgacctacgaaaacggtaacctggtacgg

SEQ ID NO: 337661 - DNA, 532 bp, Homo sapiens
  misc_feature: GZ8MTXP02IW8WR.25.56.F01.1.454.CMB.2.raw
  modified_base (204)..(204): a, c, t, g, unknown or other
  misc_feature (204)..(204): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtcctccttccttcctgtctgcatctgtggganacagagtcaccatcacttggccgggcgagtcaggacattaccaattattagctgtatcaacacaaacaggaaagtcccaagctcctgatctattctgcactccacttgcctagtcagggtcccatctcgctcagcgcagtggatcgtggacagtattcagtctacaccactcgaccgctgcagcctaggacatctagactaacttattactacgttaacaaaactacttacaactacgtaccgccccgttaacgtacgttttcggacccgtaacggggaccaacggtacgtacggtaccgtaacgaaaacggtaactttcggtaacgg

SEQ ID NO: 337662 - DNA, 516 bp, Homo sapiens
  misc_feature: GZ8MTXP02H5KK1.25.56.F01.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggcgagtcaggacattaccaattatttagcctggtatcaacacaaaccaggaaagtccctaagctaccngatctattctgcatccacttgccagtcaggggtccatctcgcttcagtcgcagtggatctggacagatttcagtctcaccatcaccggcctgcagcctgacgatcttgctaacttattactagtacaaaactattacacagtcgaccccgtactacgttttcggaccgtaacggggacccaacgacggtacggtaacctacgaaaacggtactacggtacgg

SEQ ID NO: 337663 - DNA, 509 bp, Homo sapiens
  misc_feature: GZ8MTXP02HIVQE.25.56.F01.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttctgtctgcatctgtggganacagagtcaccatcacttggccgggngagtcaggacattaccaattattagcctggtatacaacacaaaccaggaaacgtccctaaagcctcctagatctattcngcatccacttgccagtcacgggtccatctcgcttcgagcgcagtgatcgtggacagtattcgagtctacaccatcaccgctgcagccngtacatctanactacttatactntaactaaactacactacgtacgtacgtacccttacgtacgtttacggaccgtacgggacaacgtacgtacggactacgaaacgacgtgtcg

SEQ ID NO: 337664 - DNA, 534 bp, Homo sapiens
  misc_feature: GZ8MTXP02HHSQU.25.56.F01.1.454.CMB.2.raw
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgcgggcagtcaggacatacaattattagctgtatcaacacaaacagggaaactccctaaagctcctgatctattcngcatccacttcgcagtcacgggccactctcncttcagcgcgagtggatcgtggaanagtatctactctacacacacaccgcncgcacnctacgacatactactactaacttaacttactacgtaactaaaactaaactaactaactacgtaccgtacccgtaccgttacgttacggtaccggaacggaaccgaacgaacgtaacggtaacgtaacgaaacggtaaacgtacggtacg

SEQ ID NO: 337665 - DNA, 567 bp, Homo sapiens
  misc_feature: GZ8MTXP02JJJ0L.25.56.F01.1.454.CMB.2.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
  modified_base (401)..(401): a, c, t, g, unknown or other
  misc_feature (401)..(401): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttggccgggcgagtcaggacattaccaattattagcctggtatcaacacaaaccaggaaagtccctaagctcctgatctattctgcactccacttnccagtcgacggggtcccatcctcgcttcagcggcagtgatcgngggacagtattcagtctacaccatccaccggcctcgcacgtcncgacgactctagactaactttattactagtaacctaaaacttactacctaacgtacgttaccgtacccccgttacgttaacggttttccggggacccgttaacgggggaccctaacgtacggtaccggtaacccgttaacgaaaaccggtaacgtacggttaccgg

SEQ ID NO: 337666 - DNA, 659 bp, Homo sapiens
  misc_feature: GZ8MTXP02IF2ZM.25.56.F01.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatcgacccagtcctccttccttcctgtctgctatctggtggganacagactcactatctacgtcggccggngacgtcgagtactaacttaactaattagttacgactagtaactaaccaaaccgaaaccgaaacgaacggtaaactaccctaacgtcctacctagtacttcttagttctacacctactacccctacgtcaccgtacgtaccggtaccggtaccgtactccgttccgtccgttaccgtacggtaccggtacgtacggtacggtacgtacggtacggtacgtacgttacgttacgtacgttacctacctacctacgtaccgtacccgtaccgtcgaccgtaccgtaccgtacgtacgtacgttacgttacgtactaacttaacttactaactaactaactactactactacgtaccgtaccgttacgttacgttacgtacgtacgaccgtaacgtacgtacgtacgtaacgtaacggtacgtacgtcg

SEQ ID NO: 337667 - DNA, 539 bp, Homo sapiens
  misc_feature: GZ8MTXP02IEQLW.25.56.F01.1.454.CMB.2.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtcctgctatctgtggganacagagtcaccatcacttgccgggngagtcaggacataccaattattagctagtatacaacaacaaacaggaaacgtcctaaagctcagatactatctgcactccgaccttgccagtccgacgggtccagtcctcgcttcacgcgcagttggattcgnggacagtactttcagtctcacatccgaccggccncgcncgcgtcgtacgtactactactactaacttacttacttactaactaaactaactactactacgtacgtaccgtacgttacgttacgtacgtaacggtacgtaacgtacgtacgtacgtaacgtaacgtaacgtacgtcg

SEQ ID NO: 337668 - DNA, 561 bp, Homo sapiens
  misc_feature: GZ8MTXP02G3P6D.25.56.F01.1.454.CMB.2.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcacatcacttggccgggngagtcaggacataccaattattagcctgtatcaacacaaacaggaaagtccctaagcctacctgatctattcngcactccaccttgccagtcgacggggtcccatcncgcttcagcgcngtgatcgtagggacagtattcagtctacaccatccgaccggcctcgaccacgcctaggacgattcgttagacctaactttacttactcgttaacctaaaacttactacctaacgtacgtaccgtcccccgttaaagttacggttttacggacccgtaacggggaaccctaaggtacggtacggtacctaacgaaaacggtaccgtaggtaccgg

SEQ ID NO: 337669 - DNA, 528 bp, Homo sapiens
  misc_feature: GZ8MTXP02G13PL.25.56.F01.1.454.CMB.2.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacgttggccgggngagtcaggacattaccaattattagcctgtatcaacacaaacaggaaactcctaagctcctgatctattctgcatccacttnccagtcagggtccatctcgcttcagcgcagtgatcgtggacagtattcagtctacaccactccaccggctgccncgctacgactctctatactacttacttactactaactaaactactactacgtacgtaccgtacccgttacgttacggttaccggaccggtaacggaccgtaacgtacggtacgtaccgtaacgtaaacggtacgtacggtcg

SEQ ID NO: 337670 - DNA, 564 bp, Homo sapiens
  misc_feature: GZ8MTXP02I33IT.25.56.F01.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttggccgggngagtcaggacattaccaattattagcctggtatcaacacaaaccaggaaactccctaagctcctgatctatctgcatccacttnccagtcagggtcccatctcgcttcagcgcagtgatcgtagggacagtattcagtctcaccatccaccggcctcgacacgccgtacgacgacttcgtacgtacctaaactttattacgtacttaaacctaaactactaacactacgttaccgtacccgttaccgttaacggttttccggacccgtaacgggggaaccctaacggaacggttaccggaaccctaacgaaaacggtaaccgtttaggtaaccgg

SEQ ID NO: 337671 - DNA, 604 bp, Homo sapiens
  misc_feature: GZ8MTXP02JB4TH.25.56.F01.1.454.CMB.2.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctggtggganacagagtcaccatcacttggccgggngagtcaggacattaccaattattagcctaggtactacaaacacaaaccgagggaaactccctaagctcctgactctattcngcctatcctaccttgccctagtccgacggggtcccatcctcgtcttcgacggtcggctaggtggatcgtagggactaggtatttcgagttcctactacctactcccgacccggtcctcgacacgtccgtacgtacgtacttacgttacgaccttaactttacttacttactaacctaaaactactacctaacgtacgtaccgtaccccgtaacgttacggtttaccggaccggtaacggggacccaacggtaacggtacggtacctaacggtaaacggtacgtacggtaccgg

SEQ ID NO: 337672 - DNA, 550 bp, Homo sapiens
  misc_feature: GZ8MTXP02I1B8Z.25.56.F01.1.454.CMB.2.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcttctgcctgcatctgtgganacagagtcaccatcacttggccgggcgagtcaggacattaccaattattagcctggtatcaacacaaacaggaaagtccctaagctcctgatctattctgcatccacttgccagtcaggggtcccatcctcgcttcagcgcagtgatctggacagnttcagtctcgaccatccgaccgcctgcacgccgtacgacgtactcttcgacctaacttacttaacgtatacctaaaactactaccaactacggttaccgtaccccgttacgttacggtttttacggacccgttacgggggaccctaacgtacggttacggaaacccttacgaaaacggtaccgtaggttaccgg

SEQ ID NO: 337673 - DNA, 661 bp, Homo sapiens
  misc_feature: GZ8MTXP02F81U0.25.56.F01.1.454.CMB.2.raw
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcacgccgcctcagtcgtcgtcggggccccaggcgaggacgggtcaccatctcctgcacgtggggacagttaccaatacgtcggggctaccttataagtgttacactggtactacaactaacttccgacgggacacgaccccctaaactcccgtactacttcatgcctagactaaactaactccgtaccctcgacggtcgtaccctcgtaccgttcttccgtacccggtcttacccgtaacgtccgtacggaccctaccctaccgtaccgtcccttccccgtacggttcctaactcccgtaccgggttcgggcccttaccgaacgtaccgttaggacgggtaagtagggtaacggtggtaacgtttaactaaccgttcggtaccctacggttacctacgtacaacccgtaaacgacgtccgttacggtcggtttcgggtttcggtttcccgggg

SEQ ID NO: 337674 - DNA, 580 bp, Homo sapiens
  misc_feature: GZ8MTXP02HF06C.25.56.F01.1.454.CMB.2.raw
  modified_base (204)..(204): a, c, t, g, unknown or other
  misc_feature (204)..(204): n is a, c, g, or t
  modified_base (383)..(383): a, c, t, g, unknown or other
  misc_feature (383)..(383): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatcgtgtggganacagacgtcaccatcacgttggccgggtcgagtcaggactattaaccaattattagcctggtatacaacacaaaccagggaaacgtccctaagctcctagactctaattctgctatccaccttgccctagtcgacggggtccctatctcgcttcagcggacagtcggatcgtggggacngtattcaagtcctacacctatcccaccggcctgccacgtccgtggactactcgttancctaactttataccttntaaactaaaactactaccaactacggtaccgtacccgttaacgtacgtttacggaccggtaagggggaccctaacggtaggtacccggtaaccgttacggaaaacggtaaccgttaggtccgg

SEQ ID NO: 337675 - DNA, 582 bp, Homo sapiens
  misc_feature: GZ8MTXP02F2X6I.25.56.F01.1.454.CMB.2.raw
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccaggcgagagggtcaccatctcctgcacgtggggacacgttccaatacgtcggggctaccgttataaatgttcacgtggtatcaactacttccgagggacacgcccccaaactccgtacacttcatgctagactaaacaactccgtccctacacggttcgtccctagacccgtacttccgtcccggctacccgaagtccgtcggcctacctcacgtccctcccgtgtcactctacgtggcctcgagctgagagtggaacgtgtacgttactaacgtcgaccgtacgtactacgtacgaaccaacgtaacggtccgtcggtcggtttcgggtttacggtttcccggg

SEQ ID NO: 337676 - DNA, 547 bp, Homo sapiens
  misc_feature: GZ8MTXP02G5XFR.25.56.F01.1.454.CMB.2.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
  modified_base (446)..(446): a, c, t, g, unknown or other
  misc_feature (446)..(446): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggngagtcaggacattaccaattattagcctggtatcaacacaaaccagggaaatccctaaagctactgatctatctncatccaccttnccagtcaggggtccatctcncttcagtcggcagtgatcgtagggcagtattcagtctacaccactccgaccggcctgaccncggacctggactacttcttnactaacttattaactcgttaacaaaacttanacgtaactacggtaccgaccccgttacgttacggttttcgggacccgttacgggggaacctaacgaggtaccggacctaacgaaaacggtaacgtgtacgg

SEQ ID NO: 337677 - DNA, 553 bp, Homo sapiens
  misc_feature: GZ8MTXP02JLDBY.25.56.F01.1.454.CMB.2.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttcctcctgtctgcatctgtgganacagagtcaccatcacttggccgggcgagtcaggacataccaattattagcctgtatcaacacaacaggaactcctaagctcctgatctattctgctactccaactttgccagtcacggggtccagtcctcgcttcagtcgcgagtggatcgtggacagtnttcagtcctacacctatcccgtaccggctcgacacggtcctcggtaaccgtattcttacgaccttaaactttacttaactacgttaactaaaaactactactaaccgtacgtaccgtaccccgtaacgttacggtttcggaccgaacggggtaccaacgacggtacggacctagaaacggtaccgtgtcgg

SEQ ID NO: 337678 - DNA, 726 bp, Homo sapiens
  misc_feature: GZ8MTXP02IO8DV.25.56.F01.1.454.CMB.2.raw
  modified_base (231)..(231): a, c, t, g, unknown or other
  misc_feature (231)..(231): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtcctccttccttcctgtctgcatcgtgtgggagacagacgtcacatcacgttgccgggngagtcaggactaattacctaaatttatttacgccgttaggtaactaccgaaacaaaccaaaaccgaaggggaaacgttaccccgtaaagcccttaccctagtacttacttacttctcgtacctactccctaacctttcgaccccgtacggtccgaacggggttccccctaacttcccgtcccgtccgtttccgaacggtccggggtactacgggtcgggaacgttcccgtagggggtactaacggttactttacgtacgttaccttacccgacccttaacgttcccgaacccggtccgttacggacgtaccgtacccgttacgtaaccgttacgtttccttacggtaacctttaactttaacggtttactaaccgttaaacctaaaacttactaacctacgtaccgttccgacccccgtttaaacgttcggtttacggacccggtacggtaacccgaacgtacgtacggtacctaacgaacggtacgtacgtcgg

SEQ ID NO: 337679 - DNA, 560 bp, Homo sapiens
  misc_feature: GZ8MTXP02HX5N3.25.56.F01.1.454.CMB.2.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtcctccttccttctgtctgcatctggtggganacagagtcaccatcacttggccggcgagtcaggacattaccaattattagcctgtatcaacaacaaaccaggaaatccaagctccngatctatctncactccacttnccagtcgacgggtccatctcncttcagcgcagtgntcgtgganagtattcagtcttcaactactcacccgggtcctacgcacgccgttaggactacttctacgaactaaccttattaacgacttaacctaaaatctaacaacgtacgttaccgacccgttactacggtttcggaacccgttaacgggggaaccctaacgtaacggtaccggtacccgtaaacgaaacgggtaaacgtttcggtaaccgg

SEQ ID NO: 337680 - DNA, 631 bp, Homo sapiens
  misc_feature: GZ8MTXP02JRUVO.25.56.F01.1.454.CMB.2.raw
  modified_base (203)..(203): a, c, t, g, unknown or other
  misc_feature (203)..(203): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttctgtctgcatctggtggganacagagtcaccatcacgttcggccgggcgagtcaaggacattaccaattattagcctggtatcaacaacaaaccgaagggaaactaccctaagctacctagatactattctgctactcccacttgaccctaggtcgacggggtccccatcctcgtcttccaggtccggacaggtggatcgtagggactagtactttcgacgttccctacgacctacgtacccgacccggtcctcgcgtaccgtccgtacggacgtacttcgttacgaccttaaacttacgttactacgtaaactaaaactacactaactacgttaccgtacccccgtaagttaccggttttacgggaccccgtaacgggggtaaccctaacggtacggttaaccggaacccgtaacggtaaaaccgggtaaccgtacgggttaccggg

SEQ ID NO: 337681 - DNA, 547 bp, Homo sapiens
  misc_feature: GZ8MTXP02IYA8V.25.56.F01.1.454.CMB.2.raw
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtcctccttccttcctttcngctatctggtggganacagatcaccatcattggccgggnagtcaggacattaccaattattagcctgtatacaaacacaaaccgagggaaactccctaaagctacctagtactctattctgctatccacctgcacgtcgacggggtcccagtctcgtcttcagcgcagtgatcgngggacagtntttacagtctacacctactccnccggtctgaccacgacgtacgtacgtactctacgtactaacttacttacttactaactaactaactactactacgtaccgtaccgtacgtacgttacggtaccgacggacgacgtaacgtacgtacgtacgtaacgacgtacgtacgtcg

SEQ ID NO: 337682 - DNA, 600 bp, Homo sapiens
  misc_feature: GZ8MTXP02FHH3O.25.56.F01.1.454.CMB.2.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (449)..(449): a, c, t, g, unknown or other
  misc_feature (449)..(449): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggcctcccaggtaccagctgtgacatccagatgacccagtctccttccttcctgtctgcatctggtggganacagagtcaccatccacttggccgggngagtcaggacattaccaattattagcctggtactacaaacaacaaaccgaagggaaacgtaccctaaagcctcctagtactctattctgcactcctacctttgccctagtccgacggggtcccctagtcctcgcctcgagcggcagtggatcgtaggacagtattcagtctacactactccgaccggcctgactacgcgtacgacgtattccgttanacctaacttacttaacttactactaaaaacttctaacctaactacgttaccggtaccccgttaacgttacggttttcgggacccgtacgggggaacccaacggtaacggtacgtaacccggtaacgtaaaacgggtaacgtcggtaccggg

SEQ ID NO: 337683 - DNA, 698 bp, Homo sapiens
  misc_feature: GZ8MTXP02JL0MV.25.56.F01.1.454.CMB.2.raw
  modified_base (317)..(317): a, c, t, g, unknown or other
  misc_feature (317)..(317): n is a, c, g, or t
tcagactgtacagtcacgaccggtgctcgatttagcagacgtctgaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggaggcttgggtgcgaggccggggagggtccctggagacctctcctgtacagcgtctggtattgcctttggcagccatcgccctgggctggggtccnccgaggggtccaggggaacggccgtgggaggtacggggttctacgtaaaagtcggtagtaccgttccgtaggggccgggttaagtcggtacaccacgttccgtacggccgggtaacttcgtagtggaaaccggggcccctcgttacactaaactactaccgaacgagaactaacttaccgaaacggtaccttacccgtttttagaacctaaatacgaactaaccgtagaacgaagaacgacggaaccgaccgggtaccctacgtaagttagttgtcggtacgacggtacgtgaaacgggacgtaccgtcccggtaccgtaacggtacccgtaaaagtcgggtttaaactttacggttaaaacggttacggtttttaaccgg

SEQ ID NO: 337684 - DNA, 714 bp, Homo sapiens
  misc_feature: GZ8MTXP02JUQHG.25.56.F01.1.454.CMB.2.raw
  modified_base (174)..(174): a, c, t, g, unknown or other
  misc_feature (174)..(174): n is a, c, g, or t
  modified_base (193)..(193): a, c, t, g, unknown or other
  misc_feature (193)..(193): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggcctcccaggtaccagtctgtgacatccagatcgacccngtcctccttcctcctgtcngcatcgtggtagggatacgagacgtccacctatcgtacgttcggccggggacgtaaggtcgaaggtactaacttacctaaatttacttacgcctagtaacacaaacgaaccaaaaccgagggtaaactcccctaaagtcctaccgtagacttcttattctgactaccgttccaccttggccctacgtccgtaacggtcccngttcctcgtacttcgacggtcccgganacgggttaggtaacttccggtacgggtaacgtacggttaactttcgtaacgttccctaccgtacccacgttacccgaacccggtcccgtcgaacccgttccgggaccttacgggaaaccgtcgttaccttacgtaactttaaaccgtttacgtttaacttaacgttaaaccttaaaacgttacaacctacgtaccgttaccgtaccccgttaacggttacggtttaccgaccgggtaccggaaccgtaacggtacgtaccggttaaccgtaaacggaacgtacgtacggtcgg

SEQ ID NO: 337685 - DNA, 718 bp, Homo sapiens
  misc_feature: GZ8MTXP02IW01O.25.56.F01.1.454.CMB.2.raw
  modified_base (220)..(220): a, c, t, g, unknown or other
  misc_feature (220)..(220): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacgagggtcctgggcccagtctgtactgacgcagccgccctnagtgtcgtcggggccccaggcgaggacgggtcaccatctcctgcacgtggggacacgttaccaagtacgtccggggactaacctttataaagttcgtttaccaacgttggttaactaccaaaacctaaaccgtttccgaacggggaaccaccggaacccccaaacttcccgtactacttcatcgtaccttagactaaacctaaacttcccgttacccctacgtacggttccgtacccctagtaacccgttacttccgtacccggtcttacccgtaagttccgtcggaccctaccctacgaccgtcccctcccgttcggtacctacgtacccgaccggtcgggtacccttaccgaacggtaccgtacggaaggtagttacgggtaaacgggttcgtaaactttaaacgtaccgtacgtaccgttacgttacctacgttacgtaaacccgacgtaaccgtaccgtacggttccggtttgggttttaccggtttcccgggg

SEQ ID NO: 337686 - DNA, 576 bp, Homo sapiens
  misc_feature: GZ8MTXP02FSTUA.25.56.F01.1.454.CMB.2.raw
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
  modified_base (393)..(393): a, c, t, g, unknown or other
  misc_feature (393)..(393): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatgacccagtctccttccttcctgtctgcatctggtggganacagagtcacatcacttgccggngagtcaggacattaccaattattagcctggtatcaacacaaacgaggaaacgtcctaagctcctgactctattctgctactccaccttgacctacgtcgacggggtcccatcctcgtcttcacgtcggacagtggactcgtggactagtattcagtctcacgtacncaccggctcgcagctgacgtatcgtagctaacttattactacgtaactaaactactacgaacctacggtaccgtaccccgttaacgtacggtttttaccgggacccggtaacggggtaaccccaacgttaacgggtaccgggtaaacccttacggaaaacgggtaacgttacggttaaccggg

SEQ ID NO: 337687 - DNA, 645 bp, Homo sapiens
  misc_feature: GZ8MTXP02HK9XY.25.56.F01.1.454.CMB.2.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactcctcctcgcctcactgcacgagggtcctggggcccagtctgtactgacgcacgcccgcctnagtgtcgtccggggcccaggcgaggcggtcacatctcngcncgtgggacagttacagtagcggctaccttatatgtcagtgtacncaactactcgaaggaccaccgacccctaaactcccgtactacttacatcgactagtactaactaactccgtaccctacgacggtcctcccgtagtacctccttccgtcccggtaccttacccgtacgtccgtcggaccctacccgtcctccgtccccttacccgttccggtactaccgtacaccgggttcggcctaccggagtaccgtaggacgggtagtaagggtaacggttactaacgttaccgtaacgtccgtacccgtacttaccgtacgtaccggaaactacgaacgtccggtacggtttaccggtttcggggtttaccggttcccgggg

SEQ ID NO: 337688 - DNA, 545 bp, Homo sapiens
  misc_feature: GZ8MTXP02FO9TI.25.56.F01.1.454.CMB.2.raw
tcagactgtacagtcacgaccggtgctcgatttagcagacgtctgtcgggggtgagggtttagaacctatgaacattctgtagggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccaggcgagagggtcaccatctcctgcactggggacagttccaatatcgggcaccttataatgtcactggtatcaacaactcgaggacagcccccaaatccgtcatcatgctgataacaatcgtccctcaggtctccctgacctattccgtcccggtctacccaactcgtaggcccacctccacgccctccctggtcatccactggccctccaagctacggagaagtggaaacggtggtaactttacctacgtacgtcccgacgttaccatacgaactaaacacgtcccgtaggtccgttgggtttgttcccgg

SEQ ID NO: 337689 - DNA, 712 bp, Homo sapiens
  misc_feature: GZ8MTXP02ILBPG.25.56.F01.1.454.CMB.2.raw
  modified_base (366)..(366): a, c, t, g, unknown or other
  misc_feature (366)..(366): n is a, c, g, or t
tcagactgtacagtcacgaccggtgctcgatttagcagacgtctgtcgggggtgagggtttagaacctatgaacattctgtaggggctctgcttcagctgtgggcacaagaggcagcactcaggacaatctccagcatggcctggtctcctctcctcctcactctcctcgctcactgcacgagggtcctgggcccagtctgtactgacgcacgcccgcctcagtcgtccgtcggggcccagggcgaggcggtcaccactctcctgcacgtggggacagtaccaatagtcggggactaccttataatgtcatgtatacaactacttccgacgggacacgacccccaatcccgtacatttcatgctanactaaacaactccgtaccctacgtacggtccgttcccctagacccgtacttcccgtcccggtacccttacccgtaacggttccgttaccgggaccctaaccccgttccgtaacccgtcccccttaccccgtcggttaccctacttacccggtaccgtccggggtaccctcccgtaaacggtacccgtacggggtaacggtagggttacggaaaagggtttcggtaaaaccttttaccgtaaccgtacgggtacccttaacggtaccctttaagtacggaaaaccttaaaccgacggttaccccgtaggggtttccggtttacggggtttttaccggggtcccgggg

SEQ ID NO: 337690 - DNA, 639 bp, Homo sapiens
  misc_feature: GZ8MTXP02HPEU2.25.56.F01.1.454.CMB.2.raw
  modified_base (206)..(206): a, c, t, g, unknown or other
  misc_feature (206)..(206): n is a, c, g, or t
tcagactgtacagtcacgaccggtgctcgatttagcagacgtctgaacacacaaagggggcagcagtctctctcagtcaggacacagcatggacatgagggtccctgctcagctcctgggactcctgctgctctggctcccaggtaccagctgtgacatccagatcgacccagtcctcctttcctcctgtctgcatctgtaggganacagagtccacatcacgttggcccgggcgagtccaaggactacttaacctaaatttacgttacgcccttaggtactaccaaacaaccaaaaccgaaggggaaaactcccctaaagcctacctagactacttatttctagtacaacttccctacttcgaccgtaacgtcgtaacggggtcccctattcccgtgtaccgttcgaacggccggtacgtagggtcggaacttccgtaggggactaggttactttcgagttcctacacctacacccgtaccggcctcgcgtacgtccgtacggtaactacgttcttagaacttaacgtttacttaacgtactaactaaaaccttactactaacgtaccgtacgtacccgtagttacggttacggaccgacggactaacgtacgtacgacgaacgtaacgtcgtgtacg

SEQ ID NO: 337691 - DNA, 615 bp, Homo sapiens
  misc_feature: GZ8MTXP02I45BN.25.56.F01.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
tcagactgtacagtcacgaccggtgctcgatttagcagacgtctgtcggggggtgagggtttagaacctatgaacattctgtaggggctctgcttcagctgtgggcacaagaggcagcactcaggacaatctccagcatggcctggtctcctctcctcctcactctcctcgctcactgcacagggtcctgggcccagtctgccctgactcagcctgcctccgtgtctggctccnggacngtcgtcaccatctctgcactggaaccagccgtgacctagttggtgtctttaataaacttatcggtccttacctcgggtaccccaaacaaaccaaccccaggaccaacggaccccccccaaaactcaactcctaagttttaanagtntcgtactacgtaccacgtccgtccctgtcggtactttcgtcgtctcttcgtcgtcgctacgtacgtcgtcgacctaccgtccgtccctacccgtactacccgtacgtccggtccgggtaccctccggacggtccgtacgggaacggtaacggtacgtacctttacgttacgttattcgtacttacttacaacgtaacgacgaacaaccaactaacgtacggttacgtcgg

SEQ ID NO: 337692 - DNA, 528 bp, Homo sapiens
  misc_feature: GZ8MTXP01BLCR7.51.36.D03.1.454.CMB.2.raw
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtctcgggacccccggcagagggtcaccatctcttgtctgggagcagctccaacatcggaactaatactgtgaaactggtaccagcaactccccaggaacccgcccccaaactcctcatctacagtaatagtcagcgcctcgacggggtcctgacccattctctggctccaagtctggcctcctcagccctcctggccatcagtcgggctccagtctgaggtngggagtntagtattatgtgtgcgngtggtggtgtggngcgcgtagttagtagttagttgttcgttacggtaagtacggtaacgtacggtacgttaccgtccgttaacgtcg

SEQ ID NO: 337693 - DNA, 546 bp, Homo sapiens
  misc_feature: GZ8MTXP01B8GYM.51.36.D03.1.454.CMB.2.raw
  modified_base (355)..(355): a, c, t, g, unknown or other
  misc_feature (355)..(355): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgggagcagctccaacatcggaactaatactgtgaactggtaccagcaactcccaggaaccgccccaaactcctcatctacagtaatagtcagcgccctccgaggggtcctgacccgattccnctggctccaagtctggctcctcacgccctccctggccatccgagtcgggctccagtctgagatgggaggctgattatactgtgcagtcggtggatgggcagttcctagaagtgggttattacggttcgtttcgggaaagttcggggaacccgtaaagggtccgaaacccggttccgttaacgggtaacccg

SEQ ID NO: 337694 - DNA, 547 bp, Homo sapiens
  misc_feature: GZ8MTXP01BEUY0.51.36.D03.1.454.CMB.2.raw
  modified_base (190)..(190): a, c, t, g, unknown or other
  misc_feature (190)..(190): n is a, c, g, or t
  modified_base (210)..(210): a, c, t, g, unknown or other
  misc_feature (210)..(210): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctnagcgtctcgggacccccggnagaggtcaccatctcttgtctgggagcagctccaacatcggaactaatactgtagaactggtaccagcaactccccaggaaccgcccccaaactcctacatctacagtaatagtcagcggccctcgacggggtcctgacccgtattctctggctccaagtctggctcctcacgcctcctggccatcaggtggctccagtctgagtatggaggtcttagatttatacgtgtgcgagtcggtggatgggcagcctagttaaagttgggttaattggttcctttacggggaaattacggggaacctaaacggggtccacccggttcgttaacgggtcccg

SEQ ID NO: 337695 - DNA, 568 bp, Homo sapiens
  misc_feature: GZ8MTXP01D05JN.51.36.D03.1.454.CMB.2.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
tcagcgatcgtatacacgaccggtgctcgatttagctgcgtcacgatctctcttggggtcagcttcagctgtgggtagagaagacaggactcaggacaatctccagcatggccagccttccctctcctcctcaccctcctcactcactgtgcagggtcctgggcccagtctgtgctgactcagccaccctcagcgtcgtcgggacccccggcagaggtcaccatctcttgtctgggagcagctccaanatcggaaactaatactgtagaactggtaccagcaactcccgaggacccgcccccaaatcctanatctacagtaatgtcagccgccctcgacggggtccngaccgtattcnctggcctaccgaagtcctcgggcttccctacacgtcccctcccgtggccagtccgtaggttcgggccttcccgagttccgtggaaggatggggaaggtcttagtaatttatacgtgtcgacgngtcggtagggngtggctagttcgtagttagttggttattgttcgttacggaagtacggaacgtacggtccaccgtcgttaacgtccg

SEQ ID NO: 337696 - DNA, 509 bp, Homo sapiens
  misc_feature: GZ8MTXP01EMMB3.51.36.D03.1.454.CMB.2.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnagagggtcaccatctcttgttctgggancagctccaacatcggaactaatactgtgaaactggtaccagcaactccaggaaccgccccaaactcctcatctacagtaatagtcagcgcctcgagggtcctgaccgatcnctgctccaagtcngctctcacgctcctgcatcgagtcggctccagtctgagntggaggctgattatactgtgctagcgtgggtagtggcgagcctgttagtggttagttgttcgttcggtaagtaggaacgaggtacgaccgtaaccgttcgtaaccg

SEQ ID NO: 337697 - DNA, 570 bp, Homo sapiens
  misc_feature: GZ8MTXP01DE1YB.51.36.D03.1.454.CMB.2.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (380)..(380): a, c, t, g, unknown or other
  misc_feature (380)..(380): n is a, c, g, or t
  modified_base (418)..(418): a, c, t, g, unknown or other
  misc_feature (418)..(418): n is a, c, g, or t
  modified_base (460)..(460): a, c, t, g, unknown or other
  misc_feature (460)..(460): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgtcngggancagctccaacatacggaactaatactgtagaactggtaccagcaactcccaggacccgaccccaaactcctacatctacagtaatagtcagccgcctcgacggggtcctgaccgattcctctcggctcaagtcctggcctccncacgcctcctggccatcgagtggctcagtctgaggtangggaggtctagtacttatacgtgtgacgtaggtcggtagggngtggcgtcgttcgtagttaagtttggttagttacgggttcgttaacgggtaacggtaacgggtaacccgtaacggtacccgttacccggttaaccgttaacgggtaaccg

SEQ ID NO: 337698 - DNA, 617 bp, Homo sapiens
  misc_feature: GZ8MTXP01BMKDS.51.36.D03.1.454.CMB.2.raw
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggcagaggtcaccatctcttgttcgtgggagcagctaccaacatacggaactaatactgtagaactggtaccagcaacctcccgaacggaaccccgacccccaaactccctacactactacagtaatacgtcacggccggccctccggacggggttcctaggacccgtattcctcgtggtaccctaccgtaaggtcctggcccttacctcaccgtccctcccgtcggccatcgaggtcgggcctaccgagtctggaggatggggaggtctagtattacttacgtgtagcgtaggtcggtgggagtgggctaggttccgtaggttagttggttagttcggttcgtttacgggaagtacggggtaaccgtaacgggtcccgttaacccggttccgttaacgggtaaccccg

SEQ ID NO: 337699 - DNA, 620 bp, Homo sapiens
  misc_feature: GZ8MTXP01B0GMO.51.36.D03.1.454.CMB.2.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggnagaggtcaccatctcttgttctgggancagctaccaacatacggaactaatactgtagaactggtaaccacgacaacctcccgacggaaccccgacccccaaactcctacatctaacagtaatagtcagccgccctcgacggggtcctagacccgtattcctctggcctaccaagtctcggcctcctcacgtccctccgtcgccatcgacggtcgggcctccgacgtcgtagaggtacgtgggaggtcgtagtattattacgtgtcgacgtacggtcggttagggagtcggaacgtacggttccgttaggttaaagttgggtttaacttggtttacggttaccgggtaaagttacggggaaccgtaacgggttcccgttaacccggttaaccggttaacggtaacccgg

SEQ ID NO: 337700 - DNA, 668 bp, Homo sapiens
  misc_feature: GZ8MTXP01C69UF.51.36.D03.1.454.CMB.2.raw
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnaggacggtccacctatcttcgttgttcgngggacgcacgcctaccaacagtacggtaaactaatactgtacgaacgtcggtaccacgaccaaccgtacccgacggaacccgacccccaactcctacactactaacagtaactacgtacgacgccgtcccgtccggaccggggtcctacgaccgtacttcctcgtcggtacctaccgtaacgttccgtcggtccttcctccgtaccgtccctcccgtcggaccctacgttccgagggtccggtacctaccgacgttcgtaggaggtacgtacgggggtacggtacgttagttaactttacgttacgtggtacggtacggtacggtcggtagggtacgtcggaacgtacggttcgtagttaaggttggttagttcggttcgttacggaagtacgggaacgtacggtccgttaccgtccgttaacgtcg

SEQ ID NO: 337701 - DNA, 551 bp, Homo sapiens
  misc_feature: GZ8MTXP01BIZ87.51.36.D03.1.454.CMB.2.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (423)..(423): a, c, t, g, unknown or other
  misc_feature (423)..(423): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggnagagggtcaccatctcttgtctgggancagctccaacatcggaaactaatactgtagaactggtaccagcaactcccaggaacccgcccccaaactccactactctacagtaatagtcagccgccctcgacggggtcctgaccgtattctcgtggcctccgaagtcctggcctcctcacgccctcctgccagtcagtcggctcagtctgagntgggagtctgtattagtacgtgtgcgagtcggtggctgggcagccgtaggttaagttggttagttcggttcgttacgggaaagttacgggaacctaacgggttccaccggttccgttaaggtaacccg

SEQ ID NO: 337702 - DNA, 530 bp, Homo sapiens
  misc_feature: GZ8MTXP01D4QG4.51.36.D03.1.454.CMB.2.raw
  modified_base (209)..(209): a, c, t, g, unknown or other
  misc_feature (209)..(209): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctgggagcagctcaacatacggaactaatactgtagaactggtaccagcaactcccgaggaaccgccccaaatcctacatctacagtaatagtcagccgccctcgacggggtcctgaccgattctccgtgcctcaaagtctggctcctcacgccctccctgcccatcagtcgggctccgagtctagaggatgggaggtctgtattattactgtgctaggtgtggtgngngcgcgtgttagtagttagttgttcgttacggtaagtacggtaacgacgtacgttaccgtccgttcgtaacg

SEQ ID NO: 337703 - DNA, 735 bp, Homo sapiens
  misc_feature: GZ8MTXP01B8NNC.51.36.D03.1.454.CMB.2.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgtcgtgggancagctaccaanatacggaactaatactgtagaactggtaccagaccaaccctccgacggaacccgacccccaaactcctacactactaacaagtaactcgtacacggccgtccctcggtaccggggtcctgacccgtattccgtcgtcggcctacccgtaaggttcctcgggtacccttcctccgtaccgtccccgttacccgcgggtaccctaacggttccgtaacggggttccggggtccttacccggtaaggttccgttagggaacgggtaagtcggggggtaacggggttcctttaaggttaacttttacggttaaccgttggttgggaccgtaagggtccggggtttaggggacggtcggggaacccgtaggttaccgttagggttaaacggtttacgggtttaagttcggttaccggttacgggtaaacgtacggggggtaaaccctaacggggttaccccgacccggtttccccggttaaaggggtccccg

SEQ ID NO: 337704 - DNA, 620 bp, Homo sapiens
  misc_feature: GZ8MTXP01AOD5L.51.36.D03.1.454.CMB.2.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccacctcagcgtctcgggacccccggnagaggtcaccatctcttgtctgggancagctccaacagtacggaaactaatactgtagaactggtaccagcaaccgtcccaggaacccgacccccaaactccacatcctaacagtaatacgtcacgccgccctcgacggggtcctgacccgtattcctcgtgcctaccgaagttccgtggccttcctccacgtcccctccccgtcggacctacgttccgaggtccggggtcttcccgagttccgtaggaggtacgtgggaggtcgtagtagtttacttacgtgtcgagacggtcggtgggagtcggctacgttccgtaggttaagttgggttaattcggttacgttacgggtaacgtacggggtaacccgaaacgggtttcccgacccggttccgttaacgggtaaccccg

SEQ ID NO: 337705 - DNA, 668 bp, Homo sapiens
  misc_feature: GZ8MTXP01AXU0P.51.36.D03.1.454.CMB.2.raw
  modified_base (238)..(238): a, c, t, g, unknown or other
  misc_feature (238)..(238): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggaccccggcaggaggtcaccatctcttgtcgtgggancagctaccaacagtacggaactaatactgtagaacgtcggtaccagccaacctcccgaacggaacccgacccccaaactcctacactcctaacagtaatacgtcacgccggccctcggaccggggttcctagacccgtattcctcgtcggcctacccgtaacgttccgtcgggtcccttcccgttaccgacccgtccccttccccgtacgggccctaagtccgtaagggtcgggtcccctaccgtacggttccgtaggaggtaagtgggggaacggtcgttagtattttacgttaccgtgtcgaccgtaggtcgggttagggacgtgggaacgcgttaccgtaggttaagttagggtttagttcggttcggttacggaaaggtacgggaaccgtaacggtccgttaacccgttccgttaacggtaacccg

SEQ ID NO: 337706 - DNA, 550 bp, Homo sapiens
  misc_feature: GZ8MTXP01EK1Z7.51.36.D03.1.454.CMB.2.raw
  modified_base (272)..(272): a, c, t, g, unknown or other
  misc_feature (272)..(272): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
tcagcgatcgtatacacgaccggtgctcgatttagctgcgtcacgatctctcttggggtcagcttcagctgtgggtagagaagacaggactcaggacaatctccagcatggcccagcttccctctcctcctcaccctcctcactcactgtgcagggtcctgggcccagtctgtgctgactcagccacccctcagccgtcctgggaccccgggcagagggtcaccatctcttgtctgggagcagctccaacatcggaactaatactgtgaacnggtaccagcaactcccacggaacgcccccaaatcctcatctacagtaatagtcagccggccctccacgggggtcctgacccgtattctctggcctcaagtcctggcctctcacgccctccctggcccatcacgtgggctcccgagtctggngggatggggnggtcgttgttnttattacgtgtgcgnggtggtggngtgcgcgttcgtgttagttgttgttcgttcgttacggtaaggtacggtaacgtacgtaccgttaccgtaaccgttcgtaacg

SEQ ID NO: 337707 - DNA, 682 bp, Homo sapiens
  misc_feature: GZ8MTXP01APRCC.51.36.D03.1.454.CMB.2.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (568)..(568): a, c, t, g, unknown or other
  misc_feature (568)..(568): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagccgtcgtcgggaccccggnagaggtcaccatctcttgtcgtgggancagcctaccaanagtacggaactaatacgtgtagaactggtaccagaccaacctcccgaacggaaccccgaccccctaaactccctacactacctaacaagtaatacgtcacggccggaccctaccgacgggggtcctacggtaccgtactttcctaccgtcgggccctaccgtaaacgttccgtcgggcccttccgtccgaccgtccccgttccccgcgggaccctacgttaccgtacgggtccgggtccctcccgtaggttccgtagggaggtacgtagggggacggttaccgttaggttaattttaacgttacgtggtcgtacggnggtcggtaggtgcggtctacgttcgtaggttagttggttacgttcggttacgttaacgggtaacggtaccggtaaccgtacgggtaccgttacccggtcgttaacggtaacccg

SEQ ID NO: 337708 - DNA, 700 bp, Homo sapiens
  misc_feature: GZ8MTXP01C178K.51.36.D03.1.454.CMB.2.raw
  modified_base (213)..(213): a, c, t, g, unknown or other
  misc_feature (213)..(213): n is a, c, g, or t
  modified_base (245)..(245): a, c, t, g, unknown or other
  misc_feature (245)..(245): n is a, c, g, or t
  modified_base (516)..(516): a, c, t, g, unknown or other
  misc_feature (516)..(516): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagccgtcgtcgggacccccggnaggacgggtcacctatctcgttgtcgtgggancagctaccaacagtacggaactaatctgtagaaactggtaaccagacaaccgtacccgacggaacccgacccccaaactcctacacgtactaacgtaagtaacgtacgtaccaacggcccggtacccgtaccggaccgggggttaccctaggtaacccggtctttacccgttacgtcgggtaccctaccgtaaacgttccgtacggtcctccctacgaccgtccctaccgtcgacctacgtaccgaggttcgggcctaccgtagttaccgnggtaaacggtcgtaggggtaacggtccgttaaggttaactttaaacgttccgttggtcgaccgtaggtcggggttaggcgtcgggaactacggttacttaggaaagtttgggtacttcggttcgttacggtaacgtacggggtaacctaggtacccgttaccggttaaccgttaacgtaacccg

SEQ ID NO: 337709 - DNA, 743 bp, Homo sapiens
  misc_feature: GZ8MTXP01AZ6TZ.51.36.D03.1.454.CMB.2.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctcagcgtcgtcgggaccccggnagaggtcacatctnttgtcgtggancagctaccaacatacggaaactaatactgtagaactcggtaccagaccaaccgtaccccgaacgggaaccccgacccccaaactccctacactactaacaagttaactacgtccacggcccggtaccccgtcccggaccggggttccctacggacccgttactttcccgtccgtcgggtacccttacccgaaacgttccgtcggtcccttcccgtaccaccgtcccctcccggtcggaccctaacgttccgtacgggttccgggtaccttcccgaaggttcccgtaggaacgggtacgtagggggtaacggtctttaaggttaaacttttaacgttaaccgttggtacggtaccggtagggtaccgggtaggggtaacgtcgggaacgtacggttccgtaaggttagtttagggtttagttcgggttacggttaacgggtaaacgttaccgggggaaccttaaccggggtacccgttaacccggtttaaccgttaacggtaacccg

SEQ ID NO: 337710 - DNA, 736 bp, Homo sapiens
  misc_feature: GZ8MTXP01CIH1S.51.36.D03.1.454.CMB.2.raw
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggaccccggnagaggtcacctatctcttgttcgtgggancagcctaccaacacgtacggaaactaatacgtgtacgtaactcggtaaccacgaccaacccgtccccgaaacgggaaccccgacccccaaaactccctacactacctaacgaagtaacgtacgtccgacggtcccggcccctacccggtaccggggtcctacggtacccgttactttcccgttaccgtcgggtcccttaacccgtaaacggttccgtaccgggtccccttcccctcgtaccccgtccccgttccccgtccgggaccctacgtacgtaacgggtcccgggtcctacccggtagttcgtagggacgggtagttacggggaggttccgttagttactttaacgttcgttggtagtccggaggtccgggttgggacgtcgggctacggttcgttaagttaaaggttcggtttaagttcggttaccgttaggggtaaactaacggggaacccgtacgggttcccaccgggttaaccgttaacggtaacccg

SEQ ID NO: 337711 - DNA, 674 bp, Homo sapiens
  misc_feature: GZ8MTXP01B051Q.51.36.D03.1.454.CMB.2.raw
  modified_base (210)..(210): a, c, t, g, unknown or other
  misc_feature (210)..(210): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgttctgggagcagctccaacatacggaactaatactgtagaactggtaccagacaacctcccaggaacccgccccaaactcctacatctacagtaatagtcagcggccctccgacggggtcctgaccctattcctctcggctaccgaagtctcggcctcctcacgtccctcccgtcggcctactcgacggtcgggtcctccgagtcgtaggaggtagttacggggacggtcgttagtaacgtttagttaaccgtggttacgaccgtaaggtccggggttaggggtaacgttcggggaaccgtaacggttcccggttaaggttaaacggtttacgggtttaagttacgggtttaccggtttaacgggtaaaagggttaccgggggtaaacccgttaaacgggggttccccttaaacccgggttaacccgttaacggggttaaccccg

SEQ ID NO: 337712 - DNA, 611 bp, Homo sapiens
  misc_feature: GZ8MTXP01CV0BP.51.36.D03.1.454.CMB.2.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (454)..(454): a, c, t, g, unknown or other
  misc_feature (454)..(454): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggacccccggnagacggtcaccatctcttgtctggancagctacaacatacggaactaatactgtagaaactggtaccagccaacctcccgaaggaacccgcccccaaactcctacactactacagtaatagtcagccgcctccgacggggtcctgaccctattccncgtcggctcctaaaggtcctcggcttccncacgtccctcccgngcctatcgagtcggctccgagtctagagtacgtggggaacgtnttagtacgtttaatccgtaggttgccgtagggtcggtagggtacgtggaacgtacggttcttagggttaaagttgggtttacttggttccgtttaacgggaagtaacgggtaacccgtaagggttcccttaccggttaaccgttaacgggtaacccg

SEQ ID NO: 337713 - DNA, 708 bp, Homo sapiens
  misc_feature: GZ8MTXP01C7XYH.51.36.D03.1.454.CMB.2.raw
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccacctcagcgtcgtcgggaccccggnagaggtcaccntctcttgtcnggancagctacaacntacggaactatactgtagaactcggtaaccacgcaacctaccccgacggaacccgacccccaaactccctanactctaactagtaatacgtcacgccgcccttaccgaccggggtacctcggtacccgtatttcccgttaccgtcgggtacctacccgtaaacggttccgtcgggtccccttcccgtcccaaccgttccccgttaccccgtcgggaccctaacgtcccgtaaggtccggggtctttaacccggtacggttacgtagggaacgtaggtacggggtacggtacgttagttaactttacgttacgtggtacgtacggtacggtcgggtacggtacgtacggtaacgtacggttacgttaggttacggtttggtacgtttacgttaacggttaaacggtaacggtaccggtaaccgtaaccggtaccgttaccgttaaccggttaaccgtaacccg

SEQ ID NO: 337714 - DNA, 521 bp, Homo sapiens
  misc_feature: GZ8MTXP01AJT30.51.36.D03.1.454.CMB.2.raw
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgtctgggagcagctccaacatcggaactaatactgtgaactggtaccagcaactcccaggaaccggcccccaaactcctcatctacagtaatagtcagcggcctccaggggtcctgaccgattctctggcctccaagtctggcctctccncncctcctcgcncncgcgtcgctcngtgtgagagnggngtgtgtattatgtgtgcgngtggtggtgngcgcgcgtgttagttggttgttcgttcgttacggtaaggtacggtaacgtacggtaccgttaccgtccgttcgtcg

SEQ ID NO: 337715 - DNA, 788 bp, Homo sapiens
  misc_feature: GZ8MTXP01CJM4D.51.36.D03.1.454.CMB.2.raw
  modified_base (236)..(236): a, c, t, g, unknown or other
  misc_feature (236)..(236): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggagaggtcaccatctcttgtctgggancagctaccaacatcggaactaatactgtacgaactcggtaaccacgaccaacctccccgaacgggaaccccggaccccccaaaactccctaccactcctaactaagttaaactacgtacgacggcccggtccctaccggacgggggtccctaggaccctacgtttcctccgtcgggccttacccgaacggttccgtacgggtcccttccctaccgtaccggtccccgttccccgtcgggtacccctacgttacccggtacggggttccggggtacccttccccgtaacggttcccgttaagggacgggtaacggttcgggggtacgggtaccgtttaggttaaacgttttacgttacccggttggttcggtaccgtaacgggttccggggttaggggtaacgttcggggaaccgtacgggttacccggttaaggttaaaccggtttcgggtttaaggttcggtttaccgggttaacggggtaaacggttacgggggtaacccgtaaacggggttcccgttaaacccggttcccggttaacgggtaaccccgg

SEQ ID NO: 337716 - DNA, 744 bp, Homo sapiens
  misc_feature: GZ8MTXP01C8S0M.51.36.D03.1.454.CMB.2.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctccaccctcctcactcactgtgcagggtcctgggcccagtctgtgctgactcacgccaccctcagcgtcgtcgggacccccggnaggacggtcacctatctcttgttcgtgggancagcctaccaacagtacggaaactaatactgtacgaactcggtaccagaccaaccgtaccccgaacgggaaccccgacccccaaacttccctacacttacctaacgtaagtaactacgtccgaacggcccggtacccctacccggaccggggttcctacggtaacccgtactttccgtcgttcggtacccgttacccgtaaacggttccgtccgggtccccttccccgtacccgtacccgttccccgttccccggtcgggaccctacgttacccggacggttccggggtcccttacccggtacggttaccgtagggtaacggtacgtagggggtacggttccgttagttaacgtttattaccgtggttacgacgtaggtcgggtaggtacgtcggaacgtacggttcgttaagttaggtttcggttagttcggttcgttaacgggtaacggtaaccgggtaacgtaacggtccttacccgttaacggttaacgtaacccg

SEQ ID NO: 337717 - DNA, 657 bp, Homo sapiens
  misc_feature: GZ8MTXP01DDNVQ.51.36.D03.1.454.CMB.2.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (436)..(436): a, c, t, g, unknown or other
  misc_feature (436)..(436): n is a, c, g, or t
  modified_base (532)..(532): a, c, t, g, unknown or other
  misc_feature (532)..(532): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggaccccggnagaggtcaccatctcttgttcnggancagctccaacatacggaaactaatactgtacgaaactcggtaaccagaccaacctaccccgaacggaacccgaccccctaaaactcctacactacctaactaagtaatacgtccacggccggaccccttaccggacggggtacctgtaacccgtctttcctcgttcggccctaaccgaagttccgtcggtccttccccncctaccgtccctccgtacggacctagtaccgaggtcgtcctaccgtagtacgtaggaacgtgtacggggacgtcttaacgttaatttacgttacgnggtacgtacgaggtcgggtggtagtcggcgtacgttacgtacggttagttaggttagttacggttcggttacggtaacggtaacggtaacgtaacggtaccgttaccgtaaccgttaacgtaacg

SEQ ID NO: 337718 - DNA, 652 bp, Homo sapiens
  misc_feature: GZ8MTXP01CUM8C.51.36.D03.1.454.CMB.2.raw
  modified_base (549)..(549): a, c, t, g, unknown or other
  misc_feature (549)..(549): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccacctcagcgtcgtcgggaccccgggcagaggtcaccatctcttgttctgggagcagctaccaaacagtacggaaactaatactgtagaaactggtaaccagacaaccgtccccgaacgggaaccccggacccccaaaactccctacaacttacctaacgaagttaaacttacggtaccaacggcccggaccccttacccggtaacggggggtccctacggtaacccgtaactttacccgtccgttcgggcccttaacccgtaaacggttccgttacgggccctttcccctaccgtaccgccccttccccgtcgggacccaacttcgacgttcgggcctccgagtcgtagaggatggggaggttntagtattatcgtgtgngngtgnggtcgngcgcgcgtagttagtagtagttcgttcgttacggtaaggtacggaacgacgtacgttaccgtcgttaacgtaacg

SEQ ID NO: 337719 - DNA, 741 bp, Homo sapiens
  misc_feature: GZ8MTXP01B7WOD.51.36.D03.1.454.CMB.2.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccacctcagcgtcgtcgggaccccggnaggacggtcaccgtatcttcttgttcgtgggancagctaccaacagtacggaaactaagtactggtacgaacgttcggaaccaaggaccaaaccgtaccccgaaacgggaaccccgacccccctaaaactccctacacttacctaactaagtaaacttacgacgaacggtcccggaccccttacggaccgggggttacctacggtacccgtacgtttccgtaccgttcggtaccctaacccgtaaacggttcccgttacgggacccctttccctaccgaacccgggtcccccttcccggtaaacgggcccttaacgttccgaacggggttccggggacccttacccggaagttccggtaggaaaggggtaccttgggggacggtacgttacgttacgtttaacgttaacgtggttcgtaccggaggtccggttcgggtaacgggtcggtaacgtacgttacgtagttagttagttagttcgttcgttacgtaagtacggaacgtacgtacgttaccgtaacgttcgtaacg

SEQ ID NO: 337720 - DNA, 819 bp, Homo sapiens
  misc_feature: GZ8MTXP01DA32T.51.36.D03.1.454.CMB.2.raw
  modified_base (211)..(211): a, c, t, g, unknown or other
  misc_feature (211)..(211): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtctcgggacccccggnagaggtcaccatctcttgttcgtgggagcagctaccaacagtacggaactaatacgtgtagaaactcggtaacccagccaaaccgtccccgaaggaaaccccgaccccccaaaactccctacactacctaacaaggtaaactaggtccaacggtcccggtacccccgttaccggaccgggggttaccctggtaacccgtagtttccctcgttcgggaccctacccgtaaacggttccccggtacggtcccctttaccccgaccgtaacccgggtcccccttaccccggttcgggacccctaacgttaccgggtaacggggtttcggggtacccctaccggtaaacgtttccggtagggaaaccggggtagtaggggggtaaacgggtacctttaaaggttaccttttaaaagttaccgttagggttcggaaacccggttgggtacccgggggtttagggggaaccttgggggaaccctaacgggttaccccgttaaagggttaaaccggtttgggtttaacgttacgggttttccgtttaaacgggaaacggttaaacggggaacctaaacgggggtcccttaaccggttttaacgaacggtaacccg

SEQ ID NO: 337721 - DNA, 723 bp, Homo sapiens
  misc_feature: GZ8MTXP01ARYZO.51.36.D03.1.454.CMB.2.raw
  modified_base (211)..(211): a, c, t, g, unknown or other
  misc_feature (211)..(211): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggaccccggnagacggtcaccatctcttgtcgtgggagcacgctaccaacatacggaactaatactgtagaactggtaccacgacaacctacccgaacggaaccccggacccccaaactccctacacttactaactaacgtaactacgtaccgacggcccggtacccgtaccggtaccgggggttccctacggtacccgttactttccgtccgtcggtcccttacccgaacgttccgtcgtccctccgtccaccgtcccctcccggtacggtcctacgtacgtacgggtccggggtccttacccgtagttcccgtagggtacgggtaagttaggggggacggttacgttaggttaacttttacgttaaccggttggttacggaccgtaggggtcccgggtagggtaacggtcgggaacctcgggttacccgttaggttaaacgttggtttaagttcgggttacgttacgggaacgtacgggtaacgtaccggtccgttacccggtcgttaacgggtaacccg

SEQ ID NO: 337722 - DNA, 677 bp, Homo sapiens
  misc_feature: GZ8MTXP01BKLCY.51.36.D03.1.454.CMB.2.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (510)..(510): a, c, t, g, unknown or other
  misc_feature (510)..(510): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctnagccgtcgtcgggacccccggnaggaggtcaccatctcttgtcgtggancagctccaacatacggaataatactgtacgaactcggtaccagaccaacctccccgaagggaaccccgacccccctaaaacttcccctactacttacctaaaccgtaaggttaaagtacgttaccgaacggcccggttccccctaccgggaaccgggggttcccctggtaaccccggtacttttacccgccttcgggccttacccgtaaaggtcctcgggtcctccctacgaccgtcctcccgaggccatcgacggtcgggcctaccggngtcgtaggagtgtagggtacggttcgttagttagtttaacgtcgtggtacggtcgtacggtcgggtagggcgtcgggaactaggttcgtaggttacgttagggtttacttcggttacggttacggaacggtacggaacgtaacggtccttaccgtcgttaacggccc

SEQ ID NO: 337723 - DNA, 783 bp, Homo sapiens
  misc_feature: GZ8MTXP01BTCGF.51.36.D03.1.454.CMB.2.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcgagggtcctgggcccagtctgtgctgactcacgccaccctnagccgtcgtccggggaccccggnaggacggtcactnttcttcttgtcgtgganctagcctaccaanacgtacgaactaatctagtagaacgtcgacacgaccaacgtaccccgaacggaaccccgacccctaaactcctaactacttacctaacgtaaagttaacgtccggttaccgacggtaccccggtccccctaacggggtaccccgggggttacccctaggtaaccccgttaccgtttacccgttcccgggtaacgggtaccccttaaacccggtaaacgttccgtttccccggtaccccttacccgtacccgtacccgtcccccgttcccgccgggtaccctacggttaccggaacgggttccgggtcctacccggtagtacgtagggaagtacggtagggtacggtacttagtagtttaacgttccgtgggttacgaaccggtgggtccgggttaggccgttcgggaaccgtacggttaccggtaaggttaaacggttgtttaacggttaccggttacggttaacgggttaacgggaccggtaacgtacgtaccggttacccgttaacggttaaccggtaacccg

SEQ ID NO: 337724 - DNA, 664 bp, Homo sapiens
  misc_feature: GZ8MTXP01DKXLT.51.36.D03.1.454.CMB.2.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
  modified_base (512)..(512): a, c, t, g, unknown or other
  misc_feature (512)..(512): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggacccccggagaggtcacatctcttgtcngggancagctccaanatacggaactaatactgtagaactggtaccagacaacctcccgaacggaaccccgacccccaaactcctacatactanaagtaatgtcacgccggccctccgacggggtcctgaccgtacttctcgtcggcctaccgtaacgtcgtcggtcctcccgtcaccgtcccgtcccgtacggcctacgtacgtagggtccggggtcctacccgtagtccgtaggaagggtagtacgggggtaaggtcgttagttaactttaagtttccgnggttagaccgtagggtcgggtaggtgtcggaacgtacggttccgttaggttaagtttgggttaagttcggtttcggttaacgggtaacggtaacggggtaacccggtaaacggtacccgttaccgggttaacccgttaacgggtaaccccgg

SEQ ID NO: 337725 - DNA, 670 bp, Homo sapiens
  misc_feature: GZ8MTXP01BVA99.51.36.D03.1.454.CMB.2.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (395)..(395): a, c, t, g, unknown or other
  misc_feature (395)..(395): n is a, c, g, or t
tcagcgatcgtatacacgaccggtgctcgatttagctgcgtcacgatctctcttggggtcagcttcagctgtgggtagagaagacaggactcaggacaatctccagcatggccagccttccctctcctcctccaccctcctcactcactgtgcgacgggtcctgggcccagtctgtgctgactcacgcccaccctnagcgtcgtcggggacccccggnaggacggtccacctattcttcttgtcgtgggancagctaccaacatacggaaactatacgtgtacgaactcggtaccagaccaacctcccgaacggaaccccgccccaaactcctacactactacaagtaactacgtccgacgccggacctccggtaccggggtcctaggacccttnttaccctcgtcggaccctaccgtacgtccgtcggtaccctccgtcccgtaccgtcccctcccggtcggacctacgtcggtacggtcgggtcctaccgtagtcgtaggacggtagtggggacgtacttagttaatttacttacgtgtacgcgtaggtcgggttaggacgtcgggctaacggttaccgttagttagttagggttgttcggttacggttacggaaacggttacgggaaccgttacggccgttaccccggttaacgttaacggtaaccg

SEQ ID NO: 337726 - DNA, 746 bp, Homo sapiens
  misc_feature: GZ8MTXP01EH3G2.51.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtacagggtcctgggcccagtctgtgctgactcagccaccctcagcgtctgggacccccggnagaggtcaccatctcttgttctggggancagctaccaacatacgaaactaatactgtagaacgtaggtaaccagaccaacctcccgaaacggaacccgacccccaaactcctacaatactaacgaagtaaatacgtacacgccggcccctacggaaccggggtcccctagaccgtattcctctcggcctaccgaaacgtctcggccttccctcaccgtcccttcccgtcggacctaactacgtacgggttcggggtaccttacccgtaacggttccgtaggtaacgggtaagttacggtaacgggggtacggttacggttaaacgtttaaacgtttaacgttaggttacggtacgtacggtacgggtaggggtacggtacggtcggtaacggtaccgttacggttaaaggtttaaggtttaaggtttacggtttaccggtttaacgggttaaaacgggttaaacggggtaaacccgggtaaaaccgggttaacccggtaaccccggttacccggttaaccgggttaaccggtaaccg

SEQ ID NO: 337727 - DNA, 611 bp, Homo sapiens
  misc_feature: GZ8MTXP01DRNYF.51.36.D03.1.454.CMB.2.raw
  modified_base (238)..(238): a, c, t, g, unknown or other
  misc_feature (238)..(238): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggacccccggagacggtcaccatctcttgtctgggancagctaccaacatcggaactaatactgtagaactcggtaccagacaacctcccgaacggaacccgacccccaaactcctacactctaacagttaatacgtcacgccgccctccgacggggtcctagaccctattcctcgtcggcctaccgaacgttcctcggtcctcctcaccgtccctccgtcggaccacgtcgacggtcggctccgagtctaggagagtggggacgtctagtacgtttattacgtgtcgacgtaggtcggtagggtatcgggctaacggttccgtaaggttagttaggttaacttcgggttcgttaacgggaagttacgggaaccgtaaggtcccgaaccggttccgttaaggtaaccccg

SEQ ID NO: 337728 - DNA, 833 bp, Homo sapiens
  misc_feature: GZ8MTXP01BNUP4.51.36.D03.1.454.CMB.2.raw
tcagcgatcgtatacacgaccggtgctcgatttagctgcgtcacgatctctcttggggtcagcttcagctgtgggtagagaagacaggactcaggacaatctccagcatggccagccttccctctcctcctccaccctcctcactcactgtgcagggtcctgggcccagtctgtgctgactcacgccaccctcacgcgtcgtcggggacccccgggcaggacgggtcaccatcttcttgttcgtgggacgcacgctaccaacatacggaactaatactgtagaactggtaccagaccaaccgtacccgaacggaacccgaccccctaaactccctacactactaacaagttaacgtacgtcgaacgccggccccgtaccgaccgggggtcctacggacccgtacgtttcccgtacgtcgggaccctaccgtaacggttcccgtacgggtcccttaccctcccgtaccggtccccttccccgtacgggtaccctacgttaccggtacgggttccggggtcccttaccccggtaacggttcccgtagggtaaacggggtaccggttaggggggtaacgggttaccgtttacggtttaaacttttaacgtttaacccggttgggttccggtaaacggtcggggttccggggtttacgggggaacgttcggggaaccggtaaccggttacccggttaagggttaacggtttacgggttttaaggttcgggttttaccgggtttaaccggggtaaaacgggttaaccgggggtaaacccgtaaaccggggttacccgttaaccccgggtttaacccggtttaaccggggtaaccccgg

SEQ ID NO: 337729 - DNA, 600 bp, Homo sapiens
  misc_feature: GZ8MTXP01AYTW9.51.36.D03.1.454.CMB.2.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnagagggtcaccatctcttgtctgggancagctccaacatcggaactaatactgtgaactggtacagcaactcccgaggaacccgccccaaactcctacatctacagtaactgtccagccggcctccgacggggtcctaggaccgatttcctcgtggcctacccgaagtcgtggcctcctacacgccctcccgtcggcctatcgacggtcgggccttccgaggttccgtgacggtatcggggacggtcttagtatttattacgtgttgccgtaggtccggtgggtactggggctaacggccttagggttaagttgggttaacttggttccgttacgggaagttacggggtaacctaagggttcccaacccggtttcgaacggggttcccg

SEQ ID NO: 337730 - DNA, 741 bp, Homo sapiens
  misc_feature: GZ8MTXP01BYNNS.51.36.D03.1.454.CMB.2.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
tcagcgatcgtatacacgaccggtgctcgatttagctgcgtcacgatctctcttggggtcagcttcagctgtgggtagagaagacaggactcaggacaatctccagcatggccagccttccctctcctcctccaccctcctcactcactgtgcgagggtcctgggcccagtctgtgctgactcacgccaccctcacgcgtcgccgggacccccggnaggacggtcacctatcttcgttgttcgtgggacncacgtcctaccaaactagtaccggtaaactaatacgtggtacgtaaacgtcggtaaccagaccaacccgtaccccgaaacgggaaccccgaccccctaaactccctacacgttacctaactaagttaatacgtccacggcccggtcccctaccggaccggggtcctaggaacccgtactttcccgtcgtcggaccctaccgtaacggttccgtcggtccctccgtcccgaccgtccccgtcccgtcggcctagtcccgtaggtcgggtccctaccgagttcgtagggaagtcgttacggggtacggtcgttagttaacgttttaacgttccgtacggtggtaacggcgggttcggggtagggtaacgtcgggaacttcggttaccgttaggttaaggtttggtttacgttacggttaccggttaaacgggtaaacggttaccgggtaaccgtaacgggtcccttacccggtaaccggttaacggaaccccg

SEQ ID NO: 337731 - DNA, 720 bp, Homo sapiens
  misc_feature: GZ8MTXP01CXIZG.51.36.D03.1.454.CMB.2.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggacccccggnagaggtcaccatctcttgtcgngggancagcctacaacagtacggaactaatactgtanaacgtggtaccagcaaccgtccccaggaacccgacccccaaactccctacactcctaacgtaagtaacttacgtacgacgcccggtacccctccggtaaccgggggtccctaggacccgtatttcccgttcgtcggcccttaccggtaaacgttccgtcgggtccccttaccgtacccgacccgtccccgttccccgtcgggtacccctaacgttccggtaacggtcggggtacctcccgtaggttccgtagggaggtacgtggggacggtacgttagtaactttacgtacgtggttacgcgacggtgggtagggtatcgggaacctacggttcccgttaaggttacgttacggttaggtttacggttccggtttaacgggaaaaggttacgggtaaccccgttaacgggtaccccgttaaccggttaacccgttaacgggtaaccccg

SEQ ID NO: 337732 - DNA, 777 bp, Homo sapiens
  misc_feature: GZ8MTXP01A70DU.51.36.D03.1.454.CMB.2.raw
  modified_base (190)..(190): a, c, t, g, unknown or other
  misc_feature (190)..(190): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctnagcgtctgggacccccgggnaggacggtcacntctcttgtctggancagctaccaacagtacgaactaatacgtgtacgaactcggtaccagacctaaccgtacccgaacgggaaccccgaccccctaaactccctactactacctaacgtaagttaactacgtaccacggtcccgtaccccgtaccggtaccggggtaccctacggtaacccgtactttcccgtccgtcggacccttacccgtaaacgttccgtacggtcccttaccctaccgtaccgtcccgtaccccgtacggtaccctacgttccgtacgggtccgggtccctacccgtacggttccgtaggtaacgggtacgtacgggggtaacggtacgttacgttaacgtttaacgttacgttggttacggtaccgtagggtccgggttaggggtacgttcggggaactaacgggttccggttaaggttaaacggtttcgggtttaacgtttacgggttccggtttaaacggggtaaacggttaaccgggggtaaacccgtaacggggttaccccggttaacccgggttcccggttaaccgggtaacccg

SEQ ID NO: 337733 - DNA, 884 bp, Homo sapiens
  misc_feature: GZ8MTXP01D1BDF.51.36.D03.1.454.CMB.2.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcgagggtcctgggcccagtctgtgctgactcacgccacctcagcgtcgcgggaccccggnagcggtcacatctcttgtcgtgggancacgcctaccaacacgtaccggaaactaatacgtaggtacgtaaacgtcggtaaccacggaccaaacccgtcccgaaacgggaaccccgaccccctaaaactccctacaactctaaacgagttaaactacgtacgaacggccgtaccccgtaccggtaaccgggggtcctaggtaacccttacttttacccgtccggttcgggtacccttaacccggtaaacggttccgttccgggacccctttcccgtaccccgtacccgttcccccgttacccggtacccggtacccgttaacggttacccgggttaacggggttcccgggtacccgttaccggtacggttaccggtaacggggtaacggttaacgggttacgggggtaacggtttaaccgtttaaagtttaacgtttttaaccggttacggttcgggtaccggtaaccggtacggggttacggggttaagggtaccggttacgggaaccgttaaccgggttaccggtttaaagggtttaacggtttacgggttttaacggtttacgggtttaaccgggttaaacggggttaaaccgggtaaaccggggttaacccgggttaaaccgggttaccccggttaaccccggtttaaccgggttaaccgggtaaccccgg

SEQ ID NO: 337734 - DNA, 630 bp, Homo sapiens
  misc_feature: GZ8MTXP01DBH0R.51.36.D03.1.454.CMB.2.raw
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccacctnagcgtcgcgggaccccggnagaggtcaccatctcttgtcgtgggatcagctacaanatacggaacatcngtanaacgtggaccagacctaaccgtcccgaaggaaccccgaccccaaactccacatacgtactaagtaactgcacggaccgccctacgacggggtccngaacccgtntcctgcgacctacgagttcncggccttccncacctccctcgacgctacgtcgacggtcgcctcgagtcgaggtagtacgtaggggtacgtacgttagttaacttacgttcggtcggtacgaccggtacgggtcgggtacgggtacggtacggtaacgtacgttacgttacggttaaggttacggttacgttacggttacggttacggtaacggtaacggtaaccggtaaccggtaccgttaccgtaaccgttaacgtaaccg

SEQ ID NO: 337735 - DNA, 631 bp, Homo sapiens
  misc_feature: GZ8MTXP01DFO3I.51.36.D03.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctnagccgtcgtccggggacccccggnaggacggtccaccatctcttgttcgtgggagcaagctaccaacagtacggaactaatacgtgtacgaactggtaccagcaacctcccgacggaaccccgacccccaaactcctacactactaacaagtaatacgtcacggccggccctcgacggggttccctagacccgtacttccgtactcggaccctaccgaaggttcctcggccttaccgccacgtccctccgtacgctagttcaggtcggtctcgagttcgagaggtatgggaacggttgttagtaacttagttacgtgtcgacgcggtcggtaggtcgtcggaactcgttacgttagttaggttcgttagttcggttacgttaacggtaacggtaaccggaaccgtaacggtccgttaccggtaaccgttaacggtaaccg

SEQ ID NO: 337736 - DNA, 701 bp, Homo sapiens
  misc_feature: GZ8MTXP01BDVL0.51.36.D03.1.454.CMB.2.raw
  modified_base (210)..(210): a, c, t, g, unknown or other
  misc_feature (210)..(210): n is a, c, g, or t
  modified_base (274)..(274): a, c, t, g, unknown or other
  misc_feature (274)..(274): n is a, c, g, or t
tcagcgatcgtatacacgaccggtgctcgatttagctgcgtcacgatcgtctcttggggtcagcttcagctgtgggtagagaagacaggactcaggacaatctccagcatggccagcttccctctcctcctcaccctcctcactcactgtgcagggtcctgggcccagtctgtgctgactcagccacctcacgcgtctgggaccccgggnagaggtcaccatctcttgtctgggagcagctccaacatcggaataatactgtgaactggtaccngcaacctcccgaagggaacccggacccctaaactcctacactactacaagtaatcgtcacggccggcctacggacggggtcctaggacccgtattaccgcgtcggtacctacccgtaaaggttcccgtagggccttcccgtacaccgtccctaacccggtcgggaccctacttaaccgacgggtccggggtacctttcccggaaggtttccgtaacgggaaggggtttaacgtacgggggtacggttacgttacgttaacgtttacgtacgtggtacgtacggtacgggtcgggtacgggtacggtcggtccgtacggttacggtacggttaacggttacgggttaacggttacggttacggttacgggtaacggtaacggtaaccgtaaccggtaccgttacccgtaaccggttaaccggtaaccg

SEQ ID NO: 337737 - DNA, 749 bp, Homo sapiens
  misc_feature: GZ8MTXP01EPA74.51.36.D03.1.454.CMB.2.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (545)..(545): a, c, t, g, unknown or other
  misc_feature (545)..(545): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcggggaccccggnaggaggtccacctatcttcttgttcgnggancacgcctaccaaacgacgtacggaaactaagtactggtagtaaacgtcggtaaccacgaccaaccgtacccgaacggaaccccgtaccccaaacttccctacgtactactaaccgtaagttaactacgtacgacggcccggtccccgtaccggaccgggggttccctacgtaacccgtctttaccgtcgtccgggtacctacccgtaaagttccgtacgggcccttcctaacccgtcgtccccgtaccttcgggacctacgtacccgtaggtccgggtctaccgacgttcgagggtaacggngtcggggtagggtcttaacgttactttaacgtacgttcgggtacgtacgtacgggtccgggtagggtacgtcgggtaaacccgtgggttaccgttaggttaaaggtttacggtttaacgttcggtttaaaccggtttacgggaaacgtttaaccgggaaccgttaacgggtccgttaacccgggttcgttaacggggtaacccg

SEQ ID NO: 337738 - DNA, 491 bp, Homo sapiens
  misc_feature: GZ8MTXP02GHXY8.51.36.D03.1.454.CMB.2.raw
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgggagcagctccaacatcggaactaatactgtgaactggtaccagcaactcccaggaaccgcccccaaatcctcatctacagtaatagtcagcggcctcaggggtccctgaccgattctctggctccaagtctggctcctcagccctccctgccatccagtcgggctccagtctgaggatggaggctgattattactgtgcagcgtgggatggcagctgaatggttatgtcttggaatgggacaggtcacgtcaggtc

SEQ ID NO: 337739 - DNA, 531 bp, Homo sapiens
  misc_feature: GZ8MTXP02H7DCN.51.36.D03.1.454.CMB.2.raw
  modified_base (189)..(189): a, c, t, g, unknown or other
  misc_feature (189)..(189): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
tcagcgatcgtatacacgaccggtgctcgatttagctgcgtcacgatctctcttggggtcagcttcagctgtgggtagagaagacaggactcaggacaatctccagcatggccagcttcctctcctcctcaccctcctcactcactgtgcagggtcctgggcccagtctgtgctgactcagccaccctnagcgtctgggacccccggnagaggtcaccatctcttgtctgggancagctccaacatcggaaactaatactgtgaactggtaccagcaactcccaggaaccgcccccaaatcctcatctacagtaanagtcagccggcctcgaggggtccctgaccgtattcnctgctcaagtctgcctctcacgtccctcccgtgccatccgagtcgggctcccgagtctgaggtntggaggtctgatttattacgtgtgcgtagcggtgggtagtggtcgacgccgtacgtagtaggttagtcgtcgttacggtaagtaggacgacgtacgtaccgtaccgtacggtacg

SEQ ID NO: 337740 - DNA, 564 bp, Homo sapiens
  misc_feature: GZ8MTXP02HS4QY.51.36.D03.1.454.CMB.2.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (455)..(455): a, c, t, g, unknown or other
  misc_feature (455)..(455): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagaggtcaccatctcttgtctgggancagctccaaacatcggaaactaatactgtgaactggtaccagcaactcccaggaccgcccccaaactcctcatctacagtaatagtcagccggccctcgacggggtcccctagacccgtattcctctcggccttaccaagttcctgcctccctcacgtccctcccgtcggcccatcgacgtcgggccttccagtctggagatgaggtctgtattattacngtgcgagcgtgggagtggcagcctagaagttgggttaatcggttacgttacgggaaagttacggggaacctaacggggtacctacccggttaccgttaacgggtacccg

SEQ ID NO: 337741 - DNA, 512 bp, Homo sapiens
  misc_feature: GZ8MTXP02GOB9K.51.36.D03.1.454.CMB.2.raw
  modified_base (211)..(211): a, c, t, g, unknown or other
  misc_feature (211)..(211): n is a, c, g, or t
  modified_base (379)..(379): a, c, t, g, unknown or other
  misc_feature (379)..(379): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnaggagggtcaccatctcttgttctgggagcagctccaacatcggaactaatactgtgaactggtaccagcaactcccaggaaccgcccccaaatcctcatctacagtaatagtcagccggccctcgaggggtcccctgaccgattctctggctccaagtctggctccncacgcctccctcgccatcagtcgggctccgagtctgaggatggagctgattatactgtgcagcgtgggatggcagcctagaatggttatcgtcttacggaagtacggacgtacggtcaaccgtctaggtaccg

SEQ ID NO: 337742 - DNA, 495 bp, Homo sapiens
  misc_feature: GZ8MTXP02IK0Q6.51.36.D03.1.454.CMB.2.raw
  modified_base (211)..(211): a, c, t, g, unknown or other
  misc_feature (211)..(211): n is a, c, g, or t
  modified_base (355)..(355): a, c, t, g, unknown or other
  misc_feature (355)..(355): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggaccccccgggnagagggtcaccatctcttgttctgggagcagctccaacatcggaactaatactgtgaactggtaccagcaactcccaggaaccgccccaaactcctcatctacagtaatagtcagcggcctccgaggggtccctgaccgattcnctggctccaagtcctggctcctcacgcctccctaggccatcgagtcgggctccgagtcctgaggatgaggctgattatctgtgcagcgtggatggcagctgaatggttatgtctagaataggacaggtcaccgtcaggtc

SEQ ID NO: 337743 - DNA, 549 bp, Homo sapiens
  misc_feature: GZ8MTXP02IL8NE.51.36.D03.1.454.CMB.2.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnagagggtcaccatctcttgttctgggancagctccaacatcggaactaatactgtgaactggtaccagcaactccccaggaaccgcccccaaactcctcatctacagtaanagtcagcggccctcgacggggtccctgaccgattcctctggctccaagtctcggctcctcacgcctccctgccatcagtcggctcagtctgagatgagtctgtattatactgtgcaggcgtagggatggctagccgtagtaaagttggttagttcggttacgttacggggtaaagtacggggaacccgtaaacgggtacctacccggttaccgttacggtaacccg

SEQ ID NO: 337744 - DNA, 519 bp, Homo sapiens
  misc_feature: GZ8MTXP02G17VC.51.36.D03.1.454.CMB.2.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (359)..(359): a, c, t, g, unknown or other
  misc_feature (359)..(359): n is a, c, g, or t
  modified_base (424)..(424): a, c, t, g, unknown or other
  misc_feature (424)..(424): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnagagggtcaccatctcttgttctgggancagctccaacatcggaactaatactgtgaactggtaccagcaactcccaggaaccgccccaaactcctcatctacagtaatagtcagccggccctccgacggggtccctgaccgattccnctcggctcagtcctggcctcctcacgccctcccgtgcccatcgaggtcggctccagtcgtgaggntggaggctgtattatacgtgtgcgagcggtggatggcagctgagttggtagtcgtcgttaggaagtacggacgtagtccgacgtccgtagtaccg

SEQ ID NO: 337745 - DNA, 506 bp, Homo sapiens
  misc_feature: GZ8MTXP02GRZ67.51.36.D03.1.454.CMB.2.raw
  modified_base (210)..(210): a, c, t, g, unknown or other
  misc_feature (210)..(210): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgtctgggagcagctccaacatcggaactaatactgtgaactggtaccagcaactcccaggaaccgcccccaaactcctcatctacagtaatagtcagcggcctccgacggggtccctgaccgattctctggctccaagtctgctcctcagccctccctgccatcagtcggctccagtctgagatgaggctgattatactgtgcagcgtggagtgcgagctgagtgtagtagtcgttacgtaagtacggacgacggtacgtaccgtaccgtacgtaccg

SEQ ID NO: 337746 - DNA, 590 bp, Homo sapiens
  misc_feature: GZ8MTXP02IQ4YA.51.36.D03.1.454.CMB.2.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (447)..(447): a, c, t, g, unknown or other
  misc_feature (447)..(447): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgttctgggancagctccaacatcggaactaatactgtagaactggtaccagaccaacctccccaagggaacccggaccccccaaaactccctacactcctaacagtaaatagtcacggccggcccctccgacggggtcccctgaccgtattcctcgtcggctaccaagtcctggcctcctcacgtccctcccgtgccatccgaggtcggctccgagtcngaggatggaggtctagtatttatacgtgtgcgaggtcggtgggatcgggacacgtccgtagtaaagttgggtttatcggttacgttacgggtaaagtacgggtaaccgtaaacggtccgtacccggttccgtaacggtacccg

SEQ ID NO: 337747 - DNA, 563 bp, Homo sapiens
  misc_feature: GZ8MTXP02FI41Z.51.36.D03.1.454.CMB.2.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (456)..(456): a, c, t, g, unknown or other
  misc_feature (456)..(456): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgtctgggancagctccaacatcggaaactaatactgtagaactggtaccagcaacctccccaggaacccggcccccaaactccctacatcctacagtaatagtcagccggcctccgacggggtcccctagacccgtattcctctcgggcctaccgaaagttcctacggtcctccctcacgcccttcccgtcggcctatcgaggtcgggcctcccgagttcctgaagggntcggaggtctgaatttatactgtgcgagcggtgggatgggacagcctaggtaactggttatgtcgttacggaagtacgggactaacggtcgaaccgtcgtaggtacc

SEQ ID NO: 337748 - DNA, 531 bp, Homo sapiens
  misc_feature: GZ8MTXP02G2WLE.51.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (365)..(365): a, c, t, g, unknown or other
  misc_feature (365)..(365): n is a, c, g, or t
  modified_base (484)..(484): a, c, t, g, unknown or other
  misc_feature (484)..(484): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctgggancagctccaacatcggaaactaatactgtagaactggtaccagccaactccccaggaacccgcccccaaactccctcatctacagtaatagtcagccggccctccgacggggtccctgaccgtattccnctggcctcaagtctggctcctcacgccctcccgtgccatcgagtcggctccgagtctgaggtatggaggctgtattatactgtgcaggcggtagggatggcagcctagaagttggttancgttcgttaggaagtacgggacctaaggcctaccggtcgtacgaccg

SEQ ID NO: 337749 - DNA, 639 bp, Homo sapiens
  misc_feature: GZ8MTXP02HICGW.51.36.D03.1.454.CMB.2.raw
  modified_base (213)..(213): a, c, t, g, unknown or other
  misc_feature (213)..(213): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcggggaccccccgggnaggagggtccaccatctcttgttctgggagcagctccaacatacggaactaatactgtagaactggtaccagaccaactccccgaaggaacccggacccccaaactccctacactacctaacagtaatacgtcacgccggccctccgacggggtcccctgaccgtattccgtcgtcggtcctaccgtaacgtccgtcggtcctcccgtcaccgtccctcccgtcggcccatccgaggtcgggcctacccgagtctaggaggtagtaggacggtctaggtatttattaccgtgtcgaccgtagggtcggttaggggagtcgggacacggtcctaggtaaagttcgggttagttcggttaccgttaacgggtaaacggttacgggaacccgtaacgggtcccgtaaccggttaccgttacggtacccg

SEQ ID NO: 337750 - DNA, 688 bp, Homo sapiens
  misc_feature: GZ8MTXP02F444W.51.36.D03.1.454.CMB.2.raw
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (454)..(454): a, c, t, g, unknown or other
  misc_feature (454)..(454): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcacatctctgtctgggancagctccaacatcggaactatactgtgaactgtaccagcaactcccaggaaccggcccccaaactccctcatctacagtaatagtcagcgccctccgacggggtcccctgaccgtattccgtcgtcgggcctccgaaagttccgtcggccttcccgtcacgtcccttccccgtggccctatccgaggtcgggtacctcccgtagttccgtggaaacggtnttacggaacgggtccttaggtaacgttttattaaccgtggttacgcccgtaaggtccggtagggggtaattcgggggaccttaacgggcccccgttagggtaaaacgtttgggggttttaaacgttcggggtttacccggttttaaccgggggaaaacgtttaaaccgggggaaacccctaaaacggggtttccccgtaaacccgggttacccgtttaacgggggttaaccccg

SEQ ID NO: 337751 - DNA, 540 bp, Homo sapiens
  misc_feature: GZ8MTXP02JJB9P.51.36.D03.1.454.CMB.2.raw
  modified_base (210)..(210): a, c, t, g, unknown or other
  misc_feature (210)..(210): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggnagagggtcaccatctcttgtctgggagcagctccaacatcggaactaatactgtgaactggtaccagcaactcccaggaaccgcccccaaatcctcatctacagtaatagtcagccggccctcgaggggtcccctgacccgtattcctctgggcctaccaagttcctgggcctcctcacgccctccctcggccatcgagtcgggcctccgagtctgaggatggaggctgatttatacgtgtgcagcggtgggatgggcaggcctaggaattgggttatcgtcgttaggaagtacggggaacctaagggtccaccggttcgtacggtaccg

SEQ ID NO: 337752 - DNA, 738 bp, Homo sapiens
  misc_feature: GZ8MTXP02GNDLC.51.36.D03.1.454.CMB.2.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnagagggtcaccatctcttgttctgggagcagctccaacntcggaactaatactgtgaactggtaccagacaactcccaggaacccgcccccaaactcccncactctacagtaatagtcagccggccctacgacggggtcccctgaccgtattcctcgtcggcctcccaaagttcctcgggtccttcccctcacgtccctcccccgtacgggccctaacgtcccgtaacgggttccgggggacccttcccgtaacgggttcccgttcgggaaaggggtaacgtttgggaacgggggtccttagggttaaacttttaacgtttaaacccgttgggttacggccggtaagggtcccgggttagggggaagttcgggggaccgtaacgggtcccgttagggttaaaacgttggggttttaacgttacggggtttcccgtttaaccgggggtaaaagttaaacgggggtaacccgtaaaacgggggttcccctaaaaccccgggtttcccggttaacgggtttaacccccgg

SEQ ID NO: 337753 - DNA, 739 bp, Homo sapiens
  misc_feature: GZ8MTXP02GL5UM.51.36.D03.1.454.CMB.2.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctcagcgtcgtcgggacccccggnaggagggtcaccatctcttgttctgggancagcctaccaacatacggaaactaatactgtacgaactggtaccagaccaacctccccgaacgggaaccccgacccccaaactccctacactactacaagtaatacgtcacggccggtccctcggaccggggtccctagaccgtacttccgtcgtcggtcctaccgtaacgtccgtcggtcctccctccgaccgtccccttccccgtcggtacccaactccgtacggtcggggtcctacccgagttccgtaggacgggtatagggacggtctaggttaactttacgttaacgttgggtacgtcggtaacggtccggggttaggggtaacgttcggggacctaaccgggtcccgtttaagggtaaaccgtttaggggtttaacgttaccggtttaccggtttaaacgggggaaaacggtttaaccgggggtaaaaccccggtaaaacggggttacccccggtaaacccggtttacccggtttaacgggtaacccccgg

SEQ ID NO: 337754 - DNA, 556 bp, Homo sapiens
  misc_feature: GZ8MTXP02H1HZU.51.36.D03.1.454.CMB.2.raw
  modified_base (360)..(360): a, c, t, g, unknown or other
  misc_feature (360)..(360): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggcagaggtcaccatctcttgttctgggagcagctccaacatcggaactaatactgtagaactggtaccagcaactcccaggaaccgcccccaaactcctcatctacagtaatagtcagccggccctccgacggggtcccctgaccgattccnctggctccaaagttcctggcctcctcacgtccctccctggcccatcagtcggctccgagtctgagatgaggctagtattattacgtgtgtcgagtcggtgggatgggcagtcctagtaagttagggtttatcggttaccgttaggaaacgttacgggaaccgtaaacgggtcccgtaccggtaccgttacggaccg

SEQ ID NO: 337755 - DNA, 616 bp, Homo sapiens
  misc_feature: GZ8MTXP02F5ITQ.51.36.D03.1.454.CMB.2.raw
  modified_base (361)..(361): a, c, t, g, unknown or other
  misc_feature (361)..(361): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcggggaccccccgggcagagggtcaccatctcttgttctgggagcagctccaacatcggaactaatactgtagaactggtaccagcaactccccaggaaccgacccccaaactccctcatctacagtaatagtcagcgcctcgacggggtccctgaccgattcnctggcctacaagtcctggcctcctcacgccctcccgtcggccatcgagtcgggctccgagtcgtgaggactggaggtctagtatttattacgtgtgcgtaggtcggtaggggagtcgggactacggaccgttaggtaaacgtttaggggtttaacttcggttaccggtttaaggggtaaaacggttaaacgggggaaacccgtaaaacgggggttaccccgtaacccgggtttaccccggtaaggttaaccccgg

SEQ ID NO: 337756 - DNA, 626 bp, Homo sapiens
  misc_feature: GZ8MTXP02IQR0Z.51.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (401)..(401): a, c, t, g, unknown or other
  misc_feature (401)..(401): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctgggancagctccaacatcggaactaatactgtagaactggtaccagccaactcccaggaaccgcccccaaactcctcatctacagtaatagtcagccggccctcgacggggtcccctgaccgattcctctcggctcccgaagtcctcgggctccctcacgccctcccgngcccatccgaggtcgggcctccgagtcctgacggatggaggtcttagtatttacttacgtggttacgcgtaggtccggtggggaagttcgggcgaacggtccgttaggtaaaagtttcgggtttaacgttcggtttaccgtttacggggtaaaggttaacgggggtaaacccgttaaaacggggttcccgtaaccccggtttacccggttaacggggtaaccccg

SEQ ID NO: 337757 - DNA, 668 bp, Homo sapiens
  misc_feature: GZ8MTXP02HS14O.51.36.D03.1.454.CMB.2.raw
  modified_base (212)..(212): a, c, t, g, unknown or other
  misc_feature (212)..(212): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnaggaggtcaccatctcttgtctgggagcagctccaacatcggaaactaatactgtagaactggtaccagcaactcccaggaacccgcccccaaactcctacatctacagtaatagtcagccgcctccgacggggtcccctgacccgtattcctcgtcggccttaccgaagtccgtcgggcctccctccacgtccccttcccgtcggccctatccgacggtcgggtcctcccgagtccgtggaaggcgttggacggtctaggtatttattacgtgtacgcgtacggtcgggttaggggagttcgggaccgtaacggtcccgttaaggtaaacggtttcgggtttaacgttcggtttaacccggtttaaggggtaaaacggtttaaccgggggaaaacccgttaaacgggggttccccgttaaacccgggttacccggtttaacggggtaacccccgg

SEQ ID NO: 337758 - DNA, 640 bp, Homo sapiens
  misc_feature: GZ8MTXP02H1FUW.51.36.D03.1.454.CMB.2.raw
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnaggagggtcaccatctcttgttctgggancagctccaacatacggaactaatactgtagaactggtaccagcaactcccacggaccgaccccaaactccncatcacagtaangtcagccgcctcgacggggtccctgaccgtattccgtctcggtacctccgaacgttccgtcggcctcctcaccgtccctcccgtcggcccacgtcgtacggtcgggcctcccgagttccgtgggacggtatacgggaggtcgttagtacgtttaatttaccgtgttcggaccgaggtcggtaggggtagttcgggacgtaacggtcccgttaagtaaaggtttcgggttaagttcggtttaccggttaacgggtaaacggtaacggggtaaaccgtaaacgggtccctaaccccggttaccgttaacggtaacccg

SEQ ID NO: 337759 - DNA, 651 bp, Homo sapiens
  misc_feature: GZ8MTXP02IONZG.51.36.D03.1.454.CMB.2.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (375)..(375): a, c, t, g, unknown or other
  misc_feature (375)..(375): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgtctgggancagctccaanatcggaactaatactgtagaactggtaccagaccaacctccccgaaggaaccccgccccccaaactccctacactctaacagtaatagtcagccggccctacgacggggtcccctgacccgtatttccncgtcggcttacccgaagttccgtcggtcctcccgtcaccgtccctccccgtgccctagtccgaggtccgggcctccgagtccgtaggacggtagtggacggtcttaggtactttaacgttacgtggttcggacgaggtccggttaggggacttcgggccgacggtacccttaggtaaacgttgggtttaacgtcggtttacgttaccgggtaaaaggttaaccggggaacccgtaacgggtacccgtaaccccggttaccgttaacggtaaccccg

SEQ ID NO: 337760 - DNA, 575 bp, Homo sapiens
  misc_feature: GZ8MTXP02GLFNP.51.36.D03.1.454.CMB.2.raw
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (452)..(452): a, c, t, g, unknown or other
  misc_feature (452)..(452): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggacccccgggcaggaggtcaccatctcttgttctgggagcagctaccaacatacggaactaatactgtgaactggtaccagaccaactccccgaaggaacccggaccccccaaactccctacactctaacagtaatagtcagccggcctcgacggggtccctgaccgtattcncgtggcctccaagtctcggcttccncacgccctcccgtggccatcgagtcgggctccgagtcgtggagagtggacgntagtacttattacgtgtgcgagcggtagggagtcggacacgtccgtagtaaagtggttacgtggttacgttagggaaacgtaacgggaaccgtacgggtacctaccggtaccgtacggtaccg

SEQ ID NO: 337761 - DNA, 617 bp, Homo sapiens
  misc_feature: GZ8MTXP02JEZ6T.51.36.D03.1.454.CMB.2.raw
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatctcttgtctgggancagctccaacatacggaactaatactgtgaactggtaccagcaactcccaggaaccgcccccaaactccncatctacagtaatagtcagccgcctccgacggggtccctgaccgtattcctcgtggcctaccgtaagtccgtcggtccttcccncgtaccgccctcccgtcgcctactcgagtcgggtcctcgacgtcgtcgaggactggacgtcgtagtaactttagttacgtgtacgcgtaggtcggtgggagtcgggaccgtacgaccggttagtaaaggtttcggttagtttacggttacccggttaaggtaaacgggttacgggtaaaccgtaaccgggtacccgtaccccggtttaccgtacggtaaccccgg

SEQ ID NO: 337762 - DNA, 571 bp, Homo sapiens
  misc_feature: GZ8MTXP02FVTU2.51.36.D03.1.454.CMB.2.raw
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (492)..(492): a, c, t, g, unknown or other
  misc_feature (492)..(492): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccgggcaggacggtcaccatctcttgttctgggagcagctccaacatcggaaactaatactgtagaactcggtaccagaccaacctcccgaacgggaacccgacccccaaactccctcactctaacagtaatagtcagccggcctccgacggggtccctagaccgtnttctcgtcggcctccgaagtcctcgtcctcctcacgccctcccgtcgcctatcgagtcggctcgagtcnggaggntggaggtcttagtaatttattacgtgtcgcgtaggcggtagggngtcggacacggtctagtaagttggttatcgtcgttaggaagtacgggaaccgtacggtcctaccgtacgtacggtaccg

SEQ ID NO: 337763 - DNA, 593 bp, Homo sapiens
  misc_feature: GZ8MTXP02IT7U5.51.36.D03.1.454.CMB.2.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (317)..(317): a, c, t, g, unknown or other
  misc_feature (317)..(317): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggaccccccgggnaggacgggtcaccatctcttgttctgggagcagctccaanatcggaactaatactgtgaactggtaccagaccaactcccagggaacccgaccccaaactccncatcctacagtaatacgtacagccggccctccgacggggtcccctagacccgtattccgtctcgggtaccctccaacgttccgtcggcctttacccgtcaccgtccctcccgtaggcccatcgaggtcgggcctccgagtcgtaggagtacgtgacggtcgtagtattagttactggtgcgtaggcggtggagtcgggacaggacctgtaaacgttggttagtcgttacgttacggaacgtacggaccgtaggtaccaccggttcgtacggtaccg

SEQ ID NO: 337764 - DNA, 559 bp, Homo sapiens
  misc_feature: GZ8MTXP02HN30I.51.36.D03.1.454.CMB.2.raw
  modified_base (209)..(209): a, c, t, g, unknown or other
  misc_feature (209)..(209): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctgggagcagctccaacatcggaactaatactgtgaactggtaccagcaactcccaggaaccgcccccaaatcctcatctacagtaatagtcagccgccctccgacggggtccctgaccgtattcctctcggctcaagtctggcctcctcacgtccctcccgtggccatcgagtcgggctccgagtctggacggatggacggtctgacttattactggtgcgtagcggtgggatgggcagtccgtagtaagttcggttatcgttacgttacgggtaaagttacggggacccgttaaacgggtcccgtaaccggtccgttaacggtcccg

SEQ ID NO: 337765 - DNA, 542 bp, Homo sapiens
  misc_feature: GZ8MTXP02H3ISO.51.36.D03.1.454.CMB.2.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccggnaggaggtcaccatctcttgtctgggancagctccaacatcggaactaatactgtagaactggtaccagcaactcccacggaaccgacccccaaactcctacactctacagtaatagtcagcgccctcgacgggtccctgaccgattcnctgctcagtctcggcctcctcncgccctcccgtcgccatcgtagtcgggctccgagtctgacggatggagtctagtatttacttacgtgtgcgaggcggtgggagtggcacgctagtaagttggttactggttcgttacggaagtacgggaaccgtaacggtccacccgtacgttaacggccg

SEQ ID NO: 337766 - DNA, 783 bp, Homo sapiens
  misc_feature: GZ8MTXP02JXZPN.51.36.D03.1.454.CMB.2.raw
  modified_base (239)..(239): a, c, t, g, unknown or other
  misc_feature (239)..(239): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggagagggtcaccatctcttgttctgggancagctccaacatcggaactaatactgtagaactggtaccagaccaaacctccccgaagggaacccggaccccccaaaactccctacactacctaacaagttaatagtacacggcccggtccctaccggacggggttcccctacggaacccgtatttccgtcgtcgggtccctacccgtaaacggttcctcgggcccttcccttaccgacccgtcccccgttccccgtccgggtaccctaacgttcccgtaacgggttccgggggtacccttacccgtaacggttccgttacgggaaacggggtacgttagggtacggggtaccttaagggttaacttttaagtttaacccgttgggttacggtacccgtaaggggtaccggggttcgggggaagttcggggaccgtaacgggtccgttagggtaaacggtttcgggtttaaacgttcggtttaccggtttaacgggtaaaacgggttaaaccgggggtaacccgtaaacggggttaccccgtaacccggtttaccggtaacgggttaaccccgg

SEQ ID NO: 337767 - DNA, 679 bp, Homo sapiens
  misc_feature: GZ8MTXP02I0X0B.51.36.D03.1.454.CMB.2.raw
  modified_base (213)..(213): a, c, t, g, unknown or other
  misc_feature (213)..(213): n is a, c, g, or t
  modified_base (385)..(385): a, c, t, g, unknown or other
  misc_feature (385)..(385): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctcagccgtctcgggacccccggnagagggtcaccatctcttgttctgggagcacgctacccaaacagtaccggaactaatactgtagaacgtggtaccagaccaactccccgaaggaacccgacccccaaactccctcatctaacagtaactagtacagccggccctcgacggggtcccctagacccgtattccnctcgggcctccgtaaacgttcctcggcctccctcaccgtccctccccgtcgccctatccgtacggtcgggctccgtagtcctagggacggtagtaggacgggtcttagggtaatttaacgttacgtggttcgaccggtaggtcgggtaggggtaagcggtacgtaccggtccgttaaggtaaagtttggggtttaacttcggttacccgtttaaaggggaaacggttaaccggggtaacccgttaaacggggtaccccgttaacccgggtacccgtttaacggggtaaccccgg

SEQ ID NO: 337768 - DNA, 544 bp, Homo sapiens
  misc_feature: GZ8MTXP02JTU7H.51.36.D03.1.454.CMB.2.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (461)..(461): a, c, t, g, unknown or other
  misc_feature (461)..(461): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggnagagggtcaccatctcttgttctgggancagctccaacatcggaactaatactgtcgaactggtaccagcaactccccaggaacccggaccccccaaactccctacatctacagtaatagtcagccgcctccgacggggtccctcgaccgtagttctactggcctccgaagtctggcctcctcacgtccctcccgtcgccatcgagtcggctcagtctaggagatgagtctgagttatacgtgtgcgagngtggagtgcgacgcgtagagtaggttagtgttacgtacggtaagttacggaaccgacggtacgtaccgtaccgtacgtacccg

SEQ ID NO: 337769 - DNA, 712 bp, Homo sapiens
  misc_feature: GZ8MTXP02HOPEC.51.36.D03.1.454.CMB.2.raw
  modified_base (209)..(209): a, c, t, g, unknown or other
  misc_feature (209)..(209): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccacctcagcgtctcgggacccccggnaggaggtcacatctcttgtctgggagcagctccaacatcggaactaatactgtagaactggtaccagccaacctccccgaacggaacccggccccccaaactcccacactcctaacagtaatacgtacacgccggccctcccgacggggtccctgaccgtatttccgtcgtcgggcctaccgtaacgttccgtcggtcccttcccgtccgacccgtcccccttcccccgtcgggtaccccctaaacgttcccggtacgggtccgggggtacccttaccccgtacgggttcccgttaggggaaacgggttaagttcggggtaaacggggttccgttagggttaacttttaacgtttaccgttggttacggccgtagggtccgggttaggggtagttacgggcgtacggtcccgttaagtaacgtttaggttaacgtggtttacgttacgggtaaagtacgggaaaccgtacggggtacctacccggttaccgttacggtacccg

SEQ ID NO: 337770 - DNA, 566 bp, Homo sapiens
  misc_feature: GZ8MTXP02F34M8.51.36.D03.1.454.CMB.2.raw
  modified_base (238)..(238): a, c, t, g, unknown or other
  misc_feature (238)..(238): n is a, c, g, or t
  modified_base (359)..(359): a, c, t, g, unknown or other
  misc_feature (359)..(359): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggcagagggtcaccatctcttgttctgggancagctaccaacatcggaactaatactgtgaactggtaccagacaactcccaggaaccggccccaaactcctacatctaacagtaatagtcagccgcctccgacgggtccctgaccgattcnctggctcaagtctgctcctcacgccctccctgccatcagtcggctcagtcgtagacggatcggaggtctgtatttagtactgtcgcgagtcggtgggatggacgacgtccgtagtaaagttggttaacgttggttaccgtttagggaaacgtttaacggggaacccgtaaacggggtaccctaacccggttaccgtaacgggtcccg

SEQ ID NO: 337771 - DNA, 574 bp, Homo sapiens
  misc_feature: GZ8MTXP02G7D4L.51.36.D03.1.454.CMB.2.raw
  modified_base (210)..(210): a, c, t, g, unknown or other
  misc_feature (210)..(210): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgtctgggagcagctccaacatcggaactaatactgtagaactggtaccagccaactcccaggaaccgcccccaaactcctcatctacagtaatacgtcagccggcctccgacggggtcccctgaccgtattcctcgtcggccttaccaacgttcctcgggcctccctccacgtccctccccgtggcccatccgagtcgggcctccgagtctgacggatggacggtctaggtattagttacgtgtgcgaggtcggtagggatggcacggtcctaggtaagttggttactcggttacgtttacggaagttacgggacctacgggtaccacccggttaccgacggtaccg

SEQ ID NO: 337772 - DNA, 616 bp, Homo sapiens
  misc_feature: GZ8MTXP02HSBTL.51.36.D03.1.454.CMB.2.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagacggtcacatctcttgtcgnggancagctccaacatacgaactaatactgtagactcgtaccagacaacctacccgaacggacccgaccccaactcctacactactacagtaatagtcacgccgccgtcccgtaccggggtccctacgtaccgtacttccgtcgtcgtcctactacgtccgtcgtcctcctccgaccgtccctcccgtcgcctacgtcgtacggtccggtcctaccgtacgtcgtaggacggtacgtaggtacggtcgttagtactttagttacgtcggtacgtcgtaggtcggtagggtacgtcggcgtacgtcgtagtaggttacggttacgttcggttacgttacggtaagtacgggaacgtacggtaccgtaccggttacgtacggtaccg

SEQ ID NO: 337773 - DNA, 606 bp, Homo sapiens
  misc_feature: GZ8MTXP02IBMJM.51.36.D03.1.454.CMB.2.raw
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (381)..(381): a, c, t, g, unknown or other
  misc_feature (381)..(381): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagaggtcaccatctcttgtctggancagctccaacatcggaactaatactgtgaactggtaccagccaactccccgaagggaaccgcccccaaactcctacactctacagtaatagtcacgcggccctcgacggggtccctgaccgtattctctggcctacagtctggctcncacgtccctcccgtggccctagtccgacggtcggggtcctcccgtaggtcctaggacggtagttggacgggtcttagtagtttacgttacgtggttgactagggtccgggtagggacgtcgggcacggtcctaggtaaagttggtttactggtttccgtttaacggggaaagttaccggggaaccgttaaacgggtaccgtacccggtttacgtaccggtaaccg

SEQ ID NO: 337774 - DNA, 666 bp, Homo sapiens
  misc_feature: GZ8MTXP02JU6EN.51.36.D03.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (382)..(382): a, c, t, g, unknown or other
  misc_feature (382)..(382): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (483)..(483): a, c, t, g, unknown or other
  misc_feature (483)..(483): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcaggtcctggcccagtctgtgctgactcagccaccctcagcgtcgtcgggaccccggnagaggtcacatctnttgtcgtggancagctaccaacatacggaactaatactgtagaacctggaccagaccaacctcccgaacggaaccccgaccccctaaactcctacactactaacgaagttaatacgtacgacgccggtacctaccggaccggggtccctacggaaccgtnttcctcgtcggacctacgtacgtcgtcggtcctccgtacnccgtcccttcccgnggaccctagtccgtaggtccgggtcctaccgagttcgagggaaggtntacgggtacggtacttagttaacgtttacgttacgtggttcgaaccggtgggtccgggttaagggtacgcgggtaccgaaggttccggtaaggttaaggttgtttaacgtcggttaccggttaacgggaaacggtacggtaaccggtaacggtcccgtaaccggtttacggacggtaaccccg

SEQ ID NO: 337775 - DNA, 648 bp, Homo sapiens
  misc_feature: GZ8MTXP02HBJRT.51.36.D03.1.454.CMB.2.raw
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggcagagggtcaccatctcttgtctgggagcagctccaacatcggaactaatactgtgaactggtaccagcaactccaggaaccgccccaaactcctcatctacagtaatagtcagcgcctcgacggggtccctgaccgtattcctactcgggccttaccgaacgttccgtcgggtcctcccgttccgacgtcccctcccgttcgggaccctacgttcccgaggttccggggcctttacccgaacggttccgttaggaaccggggtaattgggaacggggtccttagggtaacttttaaacttaccgtcggttgaacccgtaggtccgggtaggggtatcggggactacggtcccgtaggtaaagttcggttaagttcggtacgtttaacgggaagtacggggtaaccaacggggttccacccggtttacacgggtacccg

SEQ ID NO: 337776 - DNA, 533 bp, Homo sapiens
  misc_feature: GZ8MTXP02FHFKS.51.36.D03.1.454.CMB.2.raw
  modified_base (209)..(209): a, c, t, g, unknown or other
  misc_feature (209)..(209): n is a, c, g, or t
  modified_base (359)..(359): a, c, t, g, unknown or other
  misc_feature (359)..(359): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagaggtcaccatctcttgttctgggagcagctccaacatcggaactaatactgtgaactggtaccagcaactcccaggaaccgcccccaaactcctcatctacagtaatagtcagccggccctcgacggggtcccctagaccgtattccnctggcctaccaagtctgctcctcacgccctccctggccatcagtcgggctccgagtctgaggatgaggctagtattattacctgtgcgtagcggtgggatggacagcctagaagttcggtatcgtcgttacggaagtacggggacctaagggtcctaaccgtcgtaggtacccg

SEQ ID NO: 337777 - DNA, 684 bp, Homo sapiens
  misc_feature: GZ8MTXP02JDM4L.51.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccacctcagcgtctcgggacccccggnaggagggtcaccatctcttgttctgggancagctacaacatcggaactaatactgtagaactggtaccagaccaacctcccacggaaccgacccccaaactcctcatctacagtaatacgtcacgcggcccctcgacggggtccctgaccgtacttccgtctcggcctaccgaaagttccgtcggaccttccctcgaccgtcccgttccccgtcggccctacgtccgacggtccggggccctcccggagttccgtaggacgggtagtcggtacgggtcgttaggtaacgttttaagttaccgttggttacggcgtacgggtcggtggggtacgttcgggaccgtaggtccgttacggtaaagttgggtttacgttacgggttaccggtttaacggggtaaacggttaaccgggggtaaacccgttaaacggggtacccgtaacccgggtttacccggttaacggggttaaccccg

SEQ ID NO: 337778 - DNA, 693 bp, Homo sapiens
  misc_feature: GZ8MTXP02JINZF.51.36.D03.1.454.CMB.2.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgtctgggancagctaccaacatacggaactaatactgtagaactggtaccagacaacctcccacggaaccgacccccaaactcctacactactacagtaatacgtcagccggtcctccgacggggtccctacgaccgtattccttctcgggcctccgtaacgtccgtacggccttccctcaaccgtccctcccgtcgggtccccaagttcccgtaacgggtccgggtccttccccgtaagttcccgttacggaaacggtagttagggaaccgggttcgttacgttaacgtttaacgttacgttggtacggacggtacgggtcgggtagggtacgtcggtaccgtacggtacggttaacgtaacggtttacggtttacgttacggttaaccggtttaacgggtaaacggttaaccgggtaaccgttaaaccgggttacccgtacccggttaccgtaacggtacccg

SEQ ID NO: 337779 - DNA, 681 bp, Homo sapiens
  misc_feature: GZ8MTXP02HCRRD.51.36.D03.1.454.CMB.2.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (436)..(436): a, c, t, g, unknown or other
  misc_feature (436)..(436): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccacctcagcgtcgtcgggaccccggnaggaggtcacatctcttgttctgggancagctaccaacagtacggaaactaatacgtgtacgaacttggtaccagaccaacctaccccgaacgggaaaccccggacccccaaactcctacaactacctaacgaagtaatacgtaccacggccggtaccctcccggtacggggtccctagaaccgtcttccgtcgtcggccttaccgtaagtccgtcggcttcctacnccgtccctcccgtcggaccctactcgtacgggtcgggccttaccgtacgttcgtagggaaggtacgtgggacggtcgtaggttaatttaagttaccgttggttaccgggacggtacgggtcgggtagggtacggtacggtacggtacggtacggttacggttaacggttacggtttacgttacggttacggttaacggtaacggtaacggtaacggtacggtaccgtaccgtaccgtacggtacg

SEQ ID NO: 337780 - DNA, 661 bp, Homo sapiens
  misc_feature: GZ8MTXP02H13ZK.51.36.D03.1.454.CMB.2.raw
  modified_base (189)..(189): a, c, t, g, unknown or other
  misc_feature (189)..(189): n is a, c, g, or t
  modified_base (234)..(234): a, c, t, g, unknown or other
  misc_feature (234)..(234): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccacctnagcgtctcgggacccccggaggaggtcacatctcttgtctgggancagctccaacatcggaactaatactgtagaactcggtaccagaccaacgtccccgaacggtaacccggacccccaaacgtcctacaactactaacaagtaatagtaccaggccgccctcgacggggtcccctggaccgtatttcctacgttcgggccttaccgtaaacgttccgtacgggtcctcccgttaccaccgtccctcccgtcggacccacttccgtacggtccgggtcctacccgtacgttaccgtaggtacggtacgttcggaacggtccgttaaggtatttaacgttaccgttggtacgtacgaggtccggtagggtagttcggacgtaacggtccgtagttaaagtggtttaacgtcgttacgttacggtaaacgtacggaaccgtaacggtcctaccggttaccgttacggtacccg

SEQ ID NO: 337781 - DNA, 604 bp, Homo sapiens
  misc_feature: GZ8MTXP02F2LGW.51.36.D03.1.454.CMB.2.raw
  modified_base (209)..(209): a, c, t, g, unknown or other
  misc_feature (209)..(209): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctgggagcagctaccaacatcggaactaatactgtgaactggtaccagcaactccaggaccgccccaaatcctcatctacagtaatagtcagccggcctcgacgggtcccctgacccgtattcctcgtcggcctaccgaagtctcggtcctccctcacgcccttccctcgggacccagttccgaggtcgggtctccgtagtcgtcggaggtactggaaggtctggtacttagtactgtgcgacggtggtgggtagtggactaggtaccctaggtaaagttgggtttacgttacggttaccggttttaacggaaacggttaaccggggtaacctaaacggggttcccgtaaccggttaccgtacggttaacccgg

SEQ ID NO: 337782 - DNA, 548 bp, Homo sapiens
  misc_feature: GZ8MTXP02FR303.51.36.D03.1.454.CMB.2.raw
  modified_base (211)..(211): a, c, t, g, unknown or other
  misc_feature (211)..(211): n is a, c, g, or t
  modified_base (354)..(354): a, c, t, g, unknown or other
  misc_feature (354)..(354): n is a, c, g, or t
  modified_base (437)..(437): a, c, t, g, unknown or other
  misc_feature (437)..(437): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccggnagagggtcaccatctcttgttctgggagcagctaccaacatacggaactaatactgtgaactggtaccagcaacctcccgaggaaccgacccccaaactccctcatctacagtaatagtcagccgcctccgacggggtccccngaccgtattcctctcggcctccgaagtcctcggcctcctcacgtccctaccctcggccatcacgtcggcctccgagtctgagntgagctagtatttatactgtgcgaggcgttgggatggctagcctagtaagttggttatcgtacgttacggaagttacgggaactacgggtccacggtacgtacggtacccg

SEQ ID NO: 337783 - DNA, 696 bp, Homo sapiens
  misc_feature: GZ8MTXP02GDDNW.51.36.D03.1.454.CMB.2.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnagagggtcaccatctcttgttctgggancagctccaacatcggaactaatactgtgaactggtaccagcaactcccaggaacccgcccccaaactcctacatcctaacaagtaatagtcagccggccctccgacggggtccctgaccgtattcctcgtggcctaccgaagtccgtgtccctcctccaccgtccctcccgtgccctatccgtacggtcgggcctacccgagtccgtggaacgggtagtagggaacgggtcttaggtaacttttacgttaaccgtggttcggaccgtaagggtccgggttagggggtaacgttcggggacctaacggggtcccttaggggtaaaacgtttggggttttaaacgttccggggtttaccgtttaaaccggggtaaaacggtttaaccgggggaaacccttaaaaccgggggttacccctaaaccccgggtttacccggtaaaacggggtttacccccgg

SEQ ID NO: 337784 - DNA, 522 bp, Homo sapiens
  misc_feature: GZ8MTXP02FTTRS.51.36.D03.1.454.CMB.2.raw
  modified_base (210)..(210): a, c, t, g, unknown or other
  misc_feature (210)..(210): n is a, c, g, or t
  modified_base (347)..(347): a, c, t, g, unknown or other
  misc_feature (347)..(347): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgttctgggagcagctccaacatcggaactaatactgtagaactggtaccagcaactcccaggaaccggcccccaaactcctcatctacataatatcagccggccctccgacggggtcccngaccgattctctggcctcaagtctgctcctcacgccctcccgtgccatcagcggctccagtctgaggatgaggtctgtattatacgtgtgcgagcgtaggagtggcagcctagaaattggttatcgttcgttacggaagtacgggaacctaaggtccaaccgtccgtaggtaccg

SEQ ID NO: 337785 - DNA, 517 bp, Homo sapiens
  misc_feature: GZ8MTXP02FI0HQ.51.36.D03.1.454.CMB.2.raw
  modified_base (348)..(348): a, c, t, g, unknown or other
  misc_feature (348)..(348): n is a, c, g, or t
  modified_base (421)..(421): a, c, t, g, unknown or other
  misc_feature (421)..(421): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggaccccccgggcagagggtcaccatctcttgttctgggagcagctccaacatcggaactaatactgtgaactggtaccagcaactccccaggaaccggcccccaaactcctcatctacagtaatagtcagcggccctcacggggtcccngaccgattctctggcctccaagtctggctcctcacgccctccctcggccatcagtcgggctcccagtctgagntgaggtctgtattatactgtgctgcgtgggatggcagcctgaagtggttactgtcgttacggaagtaggaccgtaggtccgacgtcctaggtaccg

SEQ ID NO: 337786 - DNA, 772 bp, Homo sapiens
  misc_feature: GZ8MTXP02JOB6X.51.36.D03.1.454.CMB.2.raw
  modified_base (212)..(212): a, c, t, g, unknown or other
  misc_feature (212)..(212): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcacgcgtcgtcgggacccccggnaggaggtcaccatctcttgttctgggacgcagctaccaacagtacggaaactaatactgtacgaactcggtaccagaccaactcccaagggaaccccgacccccaaactccctacacttacctaacagtaatacgtacgacgcccggtccctacccggtaccggggttcccctacggaacccgtatttcccgtcgttcgggaccttacccgtaaaggttcccgtcgggtcccttacccgtcgacccgtcccctttccccgtcgggacccctaagttcccgtaggtccgggggtaccctaccgtaacgggtccgttacggaagggtactagggtaacccgggttcgttaacggtttaacgtttaacgttaccggttcggtacggacggtacgggtcggggttacgggtacggtcgggtacggtacggttaccggtaacggttaacggtttacggtttacgttcggttaaccgggtttaaacgggtaaaaccgggttaacccggggtaaaccggttaacccggttacccggtaacccgggtttaccggttaacgggtacccg

SEQ ID NO: 337787 - DNA, 725 bp, Homo sapiens
  misc_feature: GZ8MTXP02F58GF.51.36.D03.1.454.CMB.2.raw
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcgacgggtcctgggcccagtctgtgctgactcacgcccaccctcacgccgtccgtcggggaccccccggngaggacgggtccaccgtattccttcgttgttcgtgggacncagcctaccaatacgtacgtaactaactactgtacgtaacgtcggtaaccagaccaaccgtaccccgaaggaaccccgaacccccaaactcctactactacctaacaagttaactacgtccgacgcccgtcccgtacggacccgggtccctacgaaccgtcttcccgtcgtccggtcctacgtaacgtctccggtcctcctcacccgtccctcccgtacggacctcgtccgtacgggtccggtacctacgtacggtcgtacggtaaacgggtacgtaggtacgtacgttacgtttaaagtttgttaaccggttgtcggaccggtaaggggtaccggtggggtaacgttcggactaacccggttggtaacggttaaggtttacgtaccggttttgtaacggttaaccgggaaacgttaccggggtaccgtaacggtcccgtaaccgtaccgttacggaaacccccg

SEQ ID NO: 337788 - DNA, 575 bp, Homo sapiens
  misc_feature: GZ8MTXP02HTWI3.51.36.D03.1.454.CMB.2.raw
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctnagcgtctgggacccccggnaggacggtcaccatctcttgttcgtgggancagctccaacatcggaaactaatactgtgaactggtaccagcaactcccaggaccgccccaaacgtccncatcacagtaatgtcagccggcctcgacggggtccctgaccgattccntcggctccaagtctagcctcctcacgccctccctgccatcaggtcggctccgagtcctagaggtatggaggtctaggtattacgttacgtggttcgccgaggtcggtggggacgtcgggacgtacggccgttagtaaacgttgggttacgtttcgttacgttacgggtaagttaacgggaacccgtaaggtcccgtaaccggttccgtaacggtcccgg

SEQ ID NO: 337789 - DNA, 734 bp, Homo sapiens
  misc_feature: GZ8MTXP02FO65D.51.36.D03.1.454.CMB.2.raw
  modified_base (213)..(213): a, c, t, g, unknown or other
  misc_feature (213)..(213): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggaccccccgggnaggacgggtcaccattctcttgttctgggagcagcctccaacatacggaactaatactgtagaactggtaaccagacaacctcccgaacgggaacccgaccccccaaaactccctacactcctacagtaactagtacaggccggccctcgacggggtccctagaccgtatttcctcgtcgggcctaccgtaaagttccgtcggtcctcccgttcgaccgtccccttcccccgtcgggacccctaagttcccgtaacgggtccggggacccttccccgtaaggttcccgttaggggaagggtaactggggtaacgggtccttaggttaaacttttacgttaaccgttggttacggccgtaaggggtcgggtagggggtagttcggggaacgtacggtaccgttagggtaaagtttcggggtttaacgttcggttaccggtttaaggggaaaacggtaaccgggggtaaacccgtaaaacgggggttcctaaccccggttaccggtttacgggtaaaccccgg

SEQ ID NO: 337790 - DNA, 718 bp, Homo sapiens
  misc_feature: GZ8MTXP02I8CFV.51.36.D03.1.454.CMB.2.raw
  modified_base (213)..(213): a, c, t, g, unknown or other
  misc_feature (213)..(213): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctgagcgtcgtcgggacccccggnaggacggtcacctatcttcttgtcgtgggacncancctaccaactagtaccggaactaagtactggtanaacgtagtacacgactaacctcccgacggaaccccgacccctaactcctacatacctaacgaagtaaactacgtacgacgtccggacctccggtaccgggtcccacgtaccgtacttccgtctcggtcctacgtacgtccgtcgtacctcccgtacgtcccgtccctcccgtcgacctaacgtcgtacgggtccggaccttaccggacgttaccgaggggtaaggtacgttacgggaccggtttacgttaaggttaaacgtttacgttaccgttgggtacggtaaccgggtagggtccgggttaaggggcgtcgggaaccgtaccggtacgttaaggttacggttaggggtttacttacccgggttggttaaacggggtaagttaaccggggaacggttacggtacccgtaacccgtagggtacccggtaaccccg

SEQ ID NO: 337791 - DNA, 627 bp, Homo sapiens
  misc_feature: GZ8MTXP02FQ9CO.51.36.D03.1.454.CMB.2.raw
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (403)..(403): a, c, t, g, unknown or other
  misc_feature (403)..(403): n is a, c, g, or t
  modified_base (444)..(444): a, c, t, g, unknown or other
  misc_feature (444)..(444): n is a, c, g, or t
  modified_base (536)..(536): a, c, t, g, unknown or other
  misc_feature (536)..(536): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcacgcgtcgtcgggaccccggnaggacggtcaccgattctcgttgttcgtgggagcagctaccaacntacggaactactacgtgtacgaactacggaccagacctaacctacccgaacggaacccggtaacccccaactcctaccacgtcctaacaacgttaatacggtacgacgtccgggtccctccggaccgggtccctacggtaaccctnttcctcggtcggtcctacgagttcctccggtcctccgtacnccgtcccgtcccgtcgcctgtacgcggtcggtctaccgtgtccgaggtagacgtgacggacgttgtaatttctacgtgtcgagtggtacggnggtaggtcacggactgtagtaagttcggttattacggtcgttaacggaagtaacggtacgtaaacggtcctaccggtacgtaccggaaccg

SEQ ID NO: 337792 - DNA, 646 bp, Homo sapiens
  misc_feature: GZ8MTXP02HKQGX.51.36.D03.1.454.CMB.2.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagccgtcgtcggggaccccggnaggacggtcaccattcttcttgttcgtggancacgctaccaacacgtacgaaactaactactgtacgaacgtcggtaccacgaccaacctacccgaaacgggaaccccgaccccctaaacctcctacaactactaacgtaagtaatcgtacgcgcccggtacctcccggaccgggtccctacgtaccgtacttcgtcgtcgtcctacgtacgttcgtacgtccctccgttaccgaccctcccgttcccgacggacctcgtaccgtaggtcggtcctacgtacgttcgaggtacgtagtacggagtacgtagttatttaatcgttgtcgtacggaggtcggtaggcgtcgtacgacgttacgtagtacgttcgttagttacgttacggtaacgtaaggtacgaacgtacgaccgtaccgttacggacgaaccgg

SEQ ID NO: 337793 - DNA, 755 bp, Homo sapiens
  misc_feature: GZ8MTXP02G5S6G.51.36.D03.1.454.CMB.2.raw
  modified_base (215)..(215): a, c, t, g, unknown or other
  misc_feature (215)..(215): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctcagccgtcgtcggggacccccggnacggaggtccacattccgtcgttcgttcgtgggagccagtcctacccaactagtaccggtaaacttaatacgtaggtacgtaaccgtacgggtaaccaacgacccgtaaaccgtacccccgaaacggggaaacccccgtacccccctaaaacccttcccctactaaccttactaaaacccgtaaagttaaaacgttacggtaccgaaccggccccggtccccgtaccggtaccggggtacccctacgggtaaccccgtatttcccgttcgtcgggtccttaccgtaacggttccgtccggtcctaccccgtcacccgtcccttaccccgcggccctaagtcgtcgggttcggacctcccgtagttccgtgggacggattacggacggtacttagttaacgtttaagttccggtggtcgacggtacggtcgggtaaggggtgtacggtacggtacgcgttaaggtacggttacgttagttcggttaccggtaggtaaacgacggggtaacccgtagtacccgttacgtacgtaacggcccg

SEQ ID NO: 337794 - DNA, 651 bp, Homo sapiens
  misc_feature: GZ8MTXP02IYUTV.51.36.D03.1.454.CMB.2.raw
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctcgggcccagtctgtgctgactcacgccaccctcagcgtcgtcgggaccccggcaggacggtcacctatcttcttcggttcgtgggagcacgcctaccaacacgtacggaaactaatactgtagaacgtacgtaccacgtaccaaccgtacccgaacggaacccgaccccaactcctacactactaactaagtaatacgacgacggccgccgtccgacgggtcccacgacgtactctactcggtcctactaacgttcgtccggctaccgtcacccgtccctcccgtacgcctacgtcgtacggtcggtacctccgtacgtccgtagaggacgtcgggacgttagttagttaagtttacttacgtggtacgtacgtacgggtcggtagggacgtcggtaacgcggttacgtaacgttaaggttgtttacgttacgttacggtaacggtaaaggtacggtaacgtacggtacccgtacggttacgtacggaaccg

SEQ ID NO: 337795 - DNA, 773 bp, Homo sapiens
  misc_feature: GZ8MTXP02FKR89.51.36.D03.1.454.CMB.2.raw
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccgggnaggaggtccaccatctcttgttctgggacncagctaccacacgtacgaactaatacgtgtacgacgtcggtaccacgaccaacccgtaccccgaaacggaaccccgaccccctaactcctactactacctaacgaacgttaacgtacgtccgacggtcccggtcccgtacccggtaccggggtcccctacggtacccttcgttcctacgtcgacctaaccgtacgttccgtcgtccctcctaccgtacccgtcccgtacccgtacgaccgtacgtaccgtacggtcggtacccttaccgtacggttcgtagggtaacggtacgttacggtacggttaccgtttagttaaccgttttaccgttacggtcggtacggtacggtaaccggggttcgggtaacggggtacgttaccgggtaccgttaacggtaccggttaaaggtttaacggtttacggtttacgttaccgggttaaccggttaacggggtaaaacggttaaccggggtaaacccggtaaaccgggttaccccgttaacccggtaccggttaccgggtaaccccg

SEQ ID NO: 337796 - DNA, 759 bp, Homo sapiens
  misc_feature: GZ8MTXP02IN7H0.51.36.D03.1.454.CMB.2.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctnagcgtcgtccgggaccccggnaggacggtccaccatctcttgtcgtgggancacgcctaccaaactagtaacggaaacttaaatacgtggtacgaaacgtcggtaacccaagtaaccgaacctaccccggaaacgggaaaccccgaccccccaaaactccctactacttacaaaccgtaagtaacgtacgtacgaccggaccggtacccgtccggtaccggggtccccttacgacccggttatttccgtccgtcgggtacccttaccgtaaacgtcccgttacgggcccttacccgtaccgtacccgtccccgtccccgttccggaccgtaaccgttcccgtacgggtcccggggtccttacccggtacgttaccggtggtaaccggggtaggttacggtaaacggttccgttagttaaccgttttaaagttacccgtggtttaacgcggtaacggttccggggttaggagttccggacgtaacggtccgtaaggttacgttaggtttacggtcgttacggttaacgtaacgtacggtaacgtacgaccgtacgtcgtaacgacccg

SEQ ID NO: 337797 - DNA, 753 bp, Homo sapiens
  misc_feature: GZ8MTXP02FHN7R.51.36.D03.1.454.CMB.2.raw
  modified_base (239)..(239): a, c, t, g, unknown or other
  misc_feature (239)..(239): n is a, c, g, or t
  modified_base (406)..(406): a, c, t, g, unknown or other
  misc_feature (406)..(406): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtccgtcgggacccccggcaggacggtcaccatctcgttgttcgnggagcagcctaccaacagtacggaaactaatacgtgtacgaacgtacggtacccagtaccaaacctcccgaaacgggaaccccgaaccccccaaatccctactacgtactaaacgaagtaaagttacgacacggcccggtccccgtaccggtaccggggttaccccnggtacccgtatttcctcgtcgcctaccgtaagttcccgtggtccctcccgtacgacccgtccccttaccccgtacggcccaacgttcgtacgggtcgggtccctacccgtagttccgagggtaacggtacgtacggacggtactttagggttaaattttacgttaacgtggtacgtccgtaacgggtgggtacggggagttacgggacgtacggttaccgggtaagttaaaggttttcggttaacgttacggtttaaccgggttaacgggtaaaacggttaaccgggggtaaaacccgtaacgggtaccccggttaacccgggttaccggttaacggtaaacccccg

SEQ ID NO: 337798 - DNA, 814 bp, Homo sapiens
  misc_feature: GZ8MTXP02I8867.51.36.D03.1.454.CMB.2.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctcagccgtcgtcgggacccccggnagaggtcacatctcttgttcgtggancagctaccaacatcggaactaatacgtgtagaacgtcggtaccagaccaaccgtccgacgggaacccgacccccctaaactcctacactctaactagtaactacgtaccgacggcccggtcccctaccggtaccggggttcccctacggtacccgttactttccttcgtcggtaccttacccgtaaaggttccgtcgggttccctcccgtacgtacccgtccccgttccccgtacggtaccctaacgtccgtaacgggtccgggggtcccttacccgtaacggttcccggtaggtaacggggtacggttacgggaacgggttccgtttaacgggtttaactttttaaaccgtttaccggttcggtttacgacggttaacggggtccggggtttagggggaacggttcgggaccgtaaaaccgttccgggtttaacggttaaaacggtttgggttttacgtttacccgggtttaccggtttaaaaggggtaaaacgggttaacccggggtaaaacccggttaaccgggttaccccggttaacccggtttaccggtttaaaccgggttaaccccgg

SEQ ID NO: 337799 - DNA, 734 bp, Homo sapiens
  misc_feature: GZ8MTXP02IHSXL.51.36.D03.1.454.CMB.2.raw
  modified_base (211)..(211): a, c, t, g, unknown or other
  misc_feature (211)..(211): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagcccacctcagcgtcgtcgggacccccggnagaggtcacattctcttagttcgtgggatcacgtccacctaacagtacggaaactaatacgtgttaacgaacgttacggtaccaagacctaaaccgtccccggaaagggaaacccccgtaccccctaaacgtccctacaacttacctaaacgtaacggttaaattacggtaccaggggccccgtaccccgttacccggtaccggggttaccctacggtaaccgtactttccgttacggtccggtaccttacccgtaaacgttccgtcggtactcccgttcgaaccgtccctacccgtcgggaccctaacgttccgaggttaccggtccttacccgaagttccgtagggaggaacgttcggacgtccgttaagttagttaactcgtttggacgttaccgtacgggtacggtggacgtcggtacgtacggttaccgtaggttaacggttaacggtttcgtacggtttaccgtacggtaacgttaacggaaccgttacggtaccgtaccggttacgtaacggtccg

SEQ ID NO: 337800 - DNA, 733 bp, Homo sapiens
  misc_feature: GZ8MTXP02FJYZA.51.36.D03.1.454.CMB.2.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
tcagcgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcacgcccaccctnagcgtcgtcggggaccccccggnaggacggtccaccattcttcttgttcgnggggancacgctaccaacatacggaactaatactgtagaactggtaccagacaacctcccgaaggaacccgacccccaaactccctactactactaacagtaatacgtcaggtcccggcctacccggacggggtccctacgtaccgtacttcctcgtcggacctaccgtaagttccgtcggtcctccgtcaccgtcccttcccgtcggacctatccgaggttccgggacctccgtaagtccgtagggacgggtatacgggtaacggtccgttagttaacgttttattaaccggtggttacggaaccgtagggtccggggttaggggtacgttacgggacgtaccgggtaccgttaagggtttaaggttagggtttaacgttaccggtttaccgggtttaaacgggtaaaacggttaaacgggggtaaccccgttaaaacggggttacccccgttaacccggttaaccgggtacccggtttaaaccccggg

SEQ ID NO: 337801 - DNA, 491 bp, Homo sapiens
  misc_feature: GZ8MTXP01DX647.10.85.H08.1.454.CMB.2.raw
  modified_base (483)..(483): a, c, t, g, unknown or other
  misc_feature (483)..(483): n is a, c, g, or t
  modified_base (488)..(491): a, c, t, g, unknown or other
  misc_feature (488)..(491): n is a, c, g, or t
tcagcatagtagtgcacgaccggtgctcgatttagtatcactcagtcgggggtccctgagactctcctgtggagcgtccggattcgactttgatacttattggatgagctgggtccgccaggctccagggaagggctggagtgggtggccaccataaaggaagatggaagtgagaactactttgtgggctctgtgaagggccgattcaccatctccagagacaacgccaagaagtcactgtatctgcaaatgaaacgatgtgagagtcgaggacacggctgtatatttctgtgcgaggggagccggctatggttcggacctctggggccagggaaccctggtcaccgtcctcatcagcctccaccaagggcccatcggtctccccctggcgccctgctccaggagcacctcgagagcacagcgccctgggctgcctggtcaaggctacttcccactctatgctgaagcggctggcgaagcgcnttagnnnn

SEQ ID NO: 337802 - DNA, 558 bp, Homo sapiens
  misc_feature: GZ8MTXP01DNOCF.10.85.H08.1.454.CMB.2.raw
  modified_base (459)..(459): a, c, t, g, unknown or other
  misc_feature (459)..(459): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccggggggtcctgagactctcctgtggagcgtccggattcgactttgatacttattggatgagctgggtccgcaggctccgaggggagggctgggagtgggtgccacataaaggagatggaagtgagaacttacgtttggtgggctcgtgggtaggaaaggggtcccgatttcgacctatcctaccagacgacaaacgaccaaagaagtcactgtatctgacaaaatgaaacgntgtgagagtcgaggacacggctgtaatatttcgtggttgcggaggggagcccgggattaagtgggttccggactcggttgggggccaaggggtaacccc

SEQ ID NO: 337803 - DNA, 523 bp, Homo sapiens
  misc_feature: GZ8MTXP01B4VJ7.10.85.H08.1.454.CMB.2.raw
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
tcagcatagtagtgcacgaccggtgctcgatttagtatcactcagtcgggggctgggaggcctggtccagccggggggtccctgagactctcctgtggagcgtccggattcgactttgatacttattggatgagctgggtccgccaggctccagggaagggctggagtgggtggccaccataaaggaagatggaagtgagaactactttgtgggctctgtgaaggccgattcaccatctccagagacaacgccaagaagtcactgtatctgcaaatgaacgatgtgagagtcgaggacacggctgtatatttctgtgcgaggggganccggctatggttcgacctcgtgggggccaggggaccctggtcaccgtntcatcagcctccacaacgggcccatcggtctcccctggccgccctgctccaggcgcacctccgaggacgcacacgccggcccctggggcctcgccgtggtcaacggctaactcccatacttgctgagcgggctggcaaggcgcangng

SEQ ID NO: 337804 - DNA, 498 bp, Homo sapiens
  misc_feature: GZ8MTXP01C1AH8.10.85.H08.1.454.CMB.2.raw
  modified_base (304)..(304): a, c, t, g, unknown or other
  misc_feature (304)..(304): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (491)..(498): a, c, t, g, unknown or other
  misc_feature (491)..(498): n is a, c, g, or t
tcagcatagtagtgcacgaccggtgctcgatttagtatcactcagtcggggggtccctgagactctcctgtggagcgtccggattcgactttgatacttattggatgagctgggtccgccaggctccagggagggctggagtgggtggccaccataaaggagatggaagtgagaactactttgtgggctctgtgaagggccgattcaccatctccagagacaacgccaaagaagtcactgtatctgcaaaatgaaacgatgtgagagtcgaggacacggctgtatatttctgtgcgaggggganccggctagtggttcggacctctgggggccagggaccctggtcaccgtctcatcagcctcccacaagggcccatcggtctccccngcgccctgctccagngcacctcgagngcacagcggccctgggctgcctggtcaaggcctacttcccactctatgctgaagcgggctggcaagggngcnttagnnnnnnnn

SEQ ID NO: 337805 - DNA, 545 bp, Homo sapiens
  misc_feature: GZ8MTXP01A3K5H.10.85.H08.1.454.CMB.2.raw
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (477)..(477): a, c, t, g, unknown or other
  misc_feature (477)..(477): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccaggccggggggtccctgagactctcctgtggagcgtccggattcgactttgatacttattggatgagcgtgggtccgccaggctcgaggggagggctggagtgggtgccacataaaggagatggaagtgagaactacgtttgngggctctgtgaagggccgattcaccatcncagagacaacgccaaagatcactgtatctgacaaatgaaacgatgtgagagtcgaaggacacgggctggtaattatttcgngttcggcgggagggcgcggattaaggtcgggttccggacctcgggttcggggccgaacggggtaaccc

SEQ ID NO: 337806 - DNA, 567 bp, Homo sapiens
  misc_feature: GZ8MTXP01AUALD.10.85.H08.1.454.CMB.2.raw
  modified_base (290)..(290): a, c, t, g, unknown or other
  misc_feature (290)..(290): n is a, c, g, or t
  modified_base (359)..(359): a, c, t, g, unknown or other
  misc_feature (359)..(359): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttcttgttgttatttagagtgtcaatgtgaggagcagctggtggagtcgtgggggaggcctggtccaggccggggggtcctgagactctctgtggagcgtccgattcgactttgatacttatggatgagctgggtccncaggctccgaggggaggggctggagtgggtgccacagtaaaggagatggaagtgagaactacgtttggngggctcgtggtggaagggccgtattcaccatctccagacgacaacgccaaaggacgtcactgtatctagacaaagtgaaacgnttggcgagagtacgacggacacgggtntgtaattntttcgnggttggacgggacggggcgccgggttattaaggtcgggttaacccggacccgtcggggcggggtaacccgaacggggtaacccc

SEQ ID NO: 337807 - DNA, 605 bp, Homo sapiens
  misc_feature: GZ8MTXP01CTR3H.10.85.H08.1.454.CMB.2.raw
  modified_base (268)..(268): a, c, t, g, unknown or other
  misc_feature (268)..(268): n is a, c, g, or t
  modified_base (358)..(358): a, c, t, g, unknown or other
  misc_feature (358)..(358): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttatttagaagtgtcaatgtgagagcagctggtggagtcgtgggggaggccgtggtccgaggcccggggggtccctggagactctcctggtggagcgtccggnttcgactttgatacttattggatgagcgtggtccgcaggctccgagggggaagggctgggaggtgggtcggccacgaagtaaaaggaagngtacggaagtggaagtaaacttacgtttggtacgggcttcgtggtagggaacggggaccgtacttcacccgattcctaccgaagacgaacaaaccgaccgaaaagaacgtcaacgttgtaactcgtagaactaaagttacgaaacgagtggtagaaggagtacggaagacgagctgttaatatttcgagttgcggaggggacgccgagtaagtcgggtcgcctcggttcgggccaaggggtaacccg

SEQ ID NO: 337808 - DNA, 710 bp, Homo sapiens
  misc_feature: GZ8MTXP01DPQD7.10.85.H08.1.454.CMB.2.raw
  modified_base (301)..(301): a, c, t, g, unknown or other
  misc_feature (301)..(301): n is a, c, g, or t
  modified_base (614)..(614): a, c, t, g, unknown or other
  misc_feature (614)..(614): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtcaatgtgaggagcagcgtggtggagtcgtgggggagccgtggtccgaggcccggggggtcctgagactctcctgtggagcgtccggattcgactttgatacttattggatgagctgggtccnccgaggctcgagggggaagggcgtgggaggtgggtggccaacgaagtaaaaggaagagtaggaagtagaagtaaacttacgtttgggtcgggtctcgtaggtagggaaacggggtccccgtaatttcccaaacctaacttcctacccgaaggaaacgaaacctaaaaccggaacccaaaaggtaaacgttccaaacgttaggttaaactccgttaaggaacctaaaaaagttcgggaaaacgtagttaggtaggaaggtaaggttaccgggaagggtaaccaacggggtcttaggtttaaattagttttccgngggttcggaccgggtagggggacgttccgggttacttaaggttcgggtttccggacccgttcgggttacgggggccccgttaacggggtaaccccg

SEQ ID NO: 337809 - DNA, 680 bp, Homo sapiens
  misc_feature: GZ8MTXP01BWNUD.10.85.H08.1.454.CMB.2.raw
  modified_base (366)..(366): a, c, t, g, unknown or other
  misc_feature (366)..(366): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccgggggggtccctgagactctcctgtggagcgtccggattcgacttgatactatggatgagctgggtccgcaggctccgagggaggggctggagtgggtgccacagtaaaggagagtggaagtgagtaacttacgtttggnggggtcttacgtggtaggaaacgggggtcccgatttccaacccagttccctacccgaaggaacgaaccaaaccggacccaaaaggaaacgttccaacgttgtaaacttctagactaaaagttggggaaaacgtagttggtaggaaaggtacggtacggaagggaaccgaaccggggtctttaggttaatttagttttcgtgggttgggaccgggaaggggggtacgccccgggggttacttaggttcgggggtttcccgggacccgtttcggtcggggggacccaacgggggtaacccccttggggtaaccccg

SEQ ID NO: 337810 - DNA, 690 bp, Homo sapiens
  misc_feature: GZ8MTXP01EYLKR.10.85.H08.1.454.CMB.2.raw
  modified_base (578)..(578): a, c, t, g, unknown or other
  misc_feature (578)..(578): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggccggggggtccctgagactctcctgtggagcgtccggattcgacttgatacttattggatgagcgtgggtcccgccaggctccgagggggaagggggtcgtgggaggtgggtcggaccaaccgaagtaaaaggaagagtagggaaagtgaagtaactaacgtttggtgggctcgtggtaggaaacgggggcccgtaatttccgaaccctattcccgtacccgaaaggaacgaaaccgaaaacccggcccaaaagggaaacgttccaaaccttggttaaactctaggggaacctaaaaagttcggaaacgtatggtaggaaggaaggtccggaaaggaccgaccgggtnttaaggttaatttatttcgttggtgggcgggttaaggggggcgttccccgggtgttaagttcgggggtttccgggaaccccttgggtaacggggggaacccctaaaaggggg

SEQ ID NO: 337811 - DNA, 518 bp, Homo sapiens
  misc_feature: GZ8MTXP01CS45D.10.85.H08.1.454.CMB.2.raw
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggcctggtccaggccggggggtccctgagactctcctgtggagcggtcggatcgacttgatacttatggatgagctggtccgcaggctccgagggagggctggagtgggtgccacataaggagatggagtgagactaattgnggctctgtgaggcgatcacntctcagnacacgcaagatcactgtatctaggcaaagtgaacgatgtgagtagtcgagggacacgggtntaagtattgttcgngtggngggagggcgccggtntacggtcgggtccgtcgttcggtcggggccgtaacggg

SEQ ID NO: 337812 - DNA, 606 bp, Homo sapiens
  misc_feature: GZ8MTXP01BZAK5.10.85.H08.1.454.CMB.2.raw
  modified_base (513)..(513): a, c, t, g, unknown or other
  misc_feature (513)..(513): n is a, c, g, or t
  modified_base (543)..(543): a, c, t, g, unknown or other
  misc_feature (543)..(543): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggcccgggggggtccctgagactctcctgtggagcgtccggattcgacttgatacttattggatgagcgtgggtccgccaggctccgagggggaaggggctgggagtgggtggccaccgaagtaaaggagagtagggaagtgaagaacttacgtttggtgggctcgtggtaggaacgggccgtattcaccatctaccagacgacaacgccaaagagtcactgtatctagacaaagtgaaacgatggtgagaggtaccgaggaccacgggcttggtaattagttttcgnggttggacgggtaagggggcgcccgggttnttaaggttcggggtttaaccgggacccttcgggttcggggggaacccaacgggggtaaccccg

SEQ ID NO: 337813 - DNA, 679 bp, Homo sapiens
  misc_feature: GZ8MTXP01DFOG8.10.85.H08.1.454.CMB.2.raw
  modified_base (566)..(566): a, c, t, g, unknown or other
  misc_feature (566)..(566): n is a, c, g, or t
  modified_base (580)..(580): a, c, t, g, unknown or other
  misc_feature (580)..(580): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagcgtgggttttccttgttgttattttagaaggtgtccaatgtgaggagcagctggtggagtcgtgggggaggccgtggtccgaggcccgggggggtccctggacgactctcctgtggagcgtccggattcgacttgatacttattggatgagcgtgggtccgcaggctcgaggggagggcgtgggaggtgggtgaccacaagtaaaggagagtaggaagtagaagtaacttacgtttgggtgggtctcgtgggtacgggaacggggcccgtattccgaaccctattccgtaaccgaaggaacgaaaccaaaccggaccaaaaggtaacgtacctaacgttagttactaccgtaggaaactaaaaagttcggaaaacgtgtaggtaggaagtacggtaaccggaaggtaccgtacgggtnttaggttaaatttntttcggtgggcggtcggggaaggggttacgcccggttagttaagggttcgggttcccggaccgtcgggttcgggggaacccggaaacgggttaaccccg

SEQ ID NO: 337814 - DNA, 743 bp, Homo sapiens
  misc_feature: GZ8MTXP01CK68C.10.85.H08.1.454.CMB.2.raw
  modified_base (369)..(369): a, c, t, g, unknown or other
  misc_feature (369)..(369): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtcctgagactctctgtggagcgtcggattcgacttgatacttatggatgagcgtgggtccgccaggctccgaggggaagggctgggagtgggtgccacagtaaaggagagtggaagtgagtaactacgtttggngggtctcgtgggtaggaaacggggccgtaattccgaccctattccgtacccgaaggaacgaaccaaacggacccaaaaggtaagtccaacttagtaactaccgtaggaacctaaaagttcgggaaaaccgtagttaggtaggaaacggaggttacccggggaaagggtaacccgtaacccggggttcgtttaagggtttaaacttttacggttttccgggtaggggttaccggggaaaccggggggtaacggggggttacccggttccccggggttacgttttaacgggggtttcccgggggtttaaccccgggtaaccccggtttcgggggttacccggggggtaacccccgttaaacggggggtaacccccg

SEQ ID NO: 337815 - DNA, 559 bp, Homo sapiens
  misc_feature: GZ8MTXP01CJWVB.10.85.H08.1.454.CMB.2.raw
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
  modified_base (535)..(535): a, c, t, g, unknown or other
  misc_feature (535)..(535): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccgagggaaggggctggagtgggtggccaccataaaggaagatggaagtgagaactactttgtgggctctgtgaaggccattcaccatctccagagacaacgccaagaagtcactgtatctgacaaatgaaacgatgtgagagtcgaggacacggctgtatatttcngtgcggagggganccggntagtggttcgacctcgnggggcagggaccctggtccaccgtncatcagcctccacgaaggcccatccggtccttccccnggccgccctgcctccgaggcncacctccgaggcgcacgacggccggcccgtgggcctcgccgtggtacaaacggtcctaaccttccccacttaaccttagttcgccttggcggccgggcncgggcgaacgggccgactaagngn

SEQ ID NO: 337816 - DNA, 605 bp, Homo sapiens
  misc_feature: GZ8MTXP01BSXIB.10.85.H08.1.454.CMB.2.raw
  modified_base (371)..(371): a, c, t, g, unknown or other
  misc_feature (371)..(371): n is a, c, g, or t
  modified_base (471)..(471): a, c, t, g, unknown or other
  misc_feature (471)..(471): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagccgtggtccgaggccggggggtcctgagctctcctgtggagcgtccggattcgactttgatactattggatgagcgtgggtccgccaggctccgagggaagggctgggagtgggtgccacagtaaaggagagtggaagtgaagtaacttacgtttggngggtctcgtggtgggaaacggggccctagttccacccatcctaccaagacgaaccaaacgaccaaaggtaactcactgtatcctagacaaattgaaacgntggtgagtagtacggaggtacagggtctggttaattagttttcgtggttcggcgggagggggacgttccggacgttaaggtcgggtttccggacgttccgggttcgggggaacccgttaacgggggtaaccccg

SEQ ID NO: 337817 - DNA, 605 bp, Homo sapiens
  misc_feature: GZ8MTXP01CVI3F.10.85.H08.1.454.CMB.2.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (565)..(565): a, c, t, g, unknown or other
  misc_feature (565)..(565): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccgaggggaaggggctgggagtgggtggccacaataaaggagatggaagtgaagaacttactttggtgggctcgtggtaggaaagggccgatttcaccatctccaagagacaacgccaaagaagtcactgtatctgacaaatgaaacgatgtagagagtcgaggacacggtntgtatatttcgnggtgacggagggggacgccggtattagttcgggttccggaccttcggtcgggggaccaggggtaacccctgggtacccaccgttctcgatccacgcccctaccgaacgaacgggccctacgtccggtccctccccgtggcccgtccctcgcctaccgaggcgcctaaccgccgaggcgccacgacggccgccgtgggctcgccgtggaccaacgcttaacctcccatacngtcgcttggcgttcgggctggaaccgaggccgataagngn

SEQ ID NO: 337818 - DNA, 575 bp, Homo sapiens
  misc_feature: GZ8MTXP01DK7I1.10.85.H08.1.454.CMB.2.raw
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (574)..(574): a, c, t, g, unknown or other
  misc_feature (574)..(574): n is a, c, g, or t
tcagcatagtagtgcacgaccggtgctcgatttagtatcactcagtcgggggctgggaggcctggtccagccggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgacaaatgaaacgatgtgagagtcgaggacacggctgtatatttctgtgcgaggggnccggntatggtcgacctcgnggggcagggaccctggtccacgtcncatcagccctccacgaacgggcccagtccggtccttccccctggcccgcccctgcctccgaggacgccacccgtcccgaggacgccaccgacgccggccccgtggggccttcgcccgttgggtaccaaacgggaccttaaccttccccacttacttagtcgcttggacggcggggctgggcaacgggcgacaagttaagng

SEQ ID NO: 337819 - DNA, 549 bp, Homo sapiens
  misc_feature: GZ8MTXP01ALA88.10.85.H08.1.454.CMB.2.raw
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagcgtggtttcgtgtaggtatttagaagtgtcaatgtgaggagcagctggtggagtcgtgggggagcctggtccgaggcccggggggtccctgagactctcctgtggagcgtccggattcgatttgattactattggatgagctgggccnccaggctcgagggagggctggngnggngcacgagaagagagagagagagagtagttgtggtcgtcgtgtagaggacgactacacactctacagacgacaacgacgaagaacgtactactagtatctagaacaagtaaggaacgtagtagtagagagacggacggacgacgtcgtagtattattgtgttggtacggagggacggtcggttcgttcgttcggtcggtcgtcggtcgggacggaccggtaaccgttcgtccg

SEQ ID NO: 337820 - DNA, 599 bp, Homo sapiens
  misc_feature: GZ8MTXP01C897G.10.85.H08.1.454.CMB.2.raw
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagcatagtagtgcacgaccggtgctcgatttagtatcactcagtcgggggctgggaggcctggtccagccgggggggtccctgagactctcctgtggagcgtccggattcgacttttgatacttattggatgagctgggtccgccaggctccgagggaagggctggagtgggtggccacataaaggagatggaagtgagaactactttgtggctctgtgaagggccattcaccatctccagagacaacgccaagaagtcactgtatctgacaaatgaacgatgtgagagtcgagacacggctgtatatttcngtgcggaggggagccggntagtggttcgacctcgtgggggccaggggaacccctggtaccaccgtctcatccacgccctaccgaccgaacgggcccagtccgggtcccttcccccgtggcccgcccttcgcctccgaggacgccacccgtcccggaggacgccaaccgacggccggcccgtggggcctcggcccgtgggtaccaaacgggtcccttaaccttccccaacttaccttagttcgcgttggacggcggggtctgggccgaagggccggactaagngng

SEQ ID NO: 337821 - DNA, 594 bp, Homo sapiens
  misc_feature: GZ8MTXP01CJQUY.10.85.H08.1.454.CMB.2.raw
  modified_base (468)..(468): a, c, t, g, unknown or other
  misc_feature (468)..(468): n is a, c, g, or t
  modified_base (507)..(507): a, c, t, g, unknown or other
  misc_feature (507)..(507): n is a, c, g, or t
  modified_base (532)..(532): a, c, t, g, unknown or other
  misc_feature (532)..(532): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggaggccgtgggtcccgaaccggggggtccctgagactctcctgtggagcgtccggattcgactttgatacttattggatgagcgtgggtccgccaggctccgaggggaggggctgggagtgggtgccacgagtaaaggaagagtgggaagtggagtaacttacgtttggtgggctcgtggtaggaagggccgtattccaccatcctccaggacgacaacgaccaaagacgtcactgtatctgacaaagtgaaacgntggagagagtcgaggactacggcttagtataattttcgnggtcggcgggagggggcgccggttnttacggttcgggttccggaaccgttcgggtacgggggacccgtaacggggttaacccgtcgg

SEQ ID NO: 337822 - DNA, 586 bp, Homo sapiens
  misc_feature: GZ8MTXP01CW3BM.10.85.H08.1.454.CMB.2.raw
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccgagggaaggggctggagtgggtggccaccataaaggagatggaagtgagaactacttgtgggctctgtgaagggctgattcaccatctccagagacaacgccaagaagtcactgtatctgacaaatgaacgatgtgagagtcgaggacacggctgtatatttcngtgcgagggganccggctagtggttcgacccctcgtgggggccagggaaccctgggtccnccgtntcatcacgccctccaaccgaacgggccctacgtccggtcccttcccccgtggcccgccccttgccgtcccgagggacgccgacccgtccgggaagacgccacgcggcccggcccgtcgggcctcgtccgttggaccaacggtaacctaccttcccacttacgtatcgcgttgacggtcgggactgggcgaggccgtcaagtaag

SEQ ID NO: 337823 - DNA, 741 bp, Homo sapiens
  misc_feature: GZ8MTXP01BIQLU.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttatttagaaggtgtcaatgtgaggagcagctggtggagtcgtgggggagccgtggtccgaggcccggggggtcctgagactctcctggtggagcgtccggattcgacttgatacttagttggatgagcgtgggtccgcaggctccggaggggagggcgtggaggtgggtggaccaacgaagtaaaggaagagtacggaaggtgaagtaacttagtttagggacgggtctcgttgggtagggaacggggtaccgtattcgaaccctagtccctaccgaagacgaaaccaaaccggtaccaaaaggtaacgtccacgtgtaactcgtagaacggtaaaatcgggaaacgtagttggtaagggaaggtaacggttacccgggaagggtaacccggtacggggtccttttaagggggttaaattttacgttttccgggtttaagggttacgggggtacccgggggaaggggggttaaccggttccccgggtttacgttaagggtttcccgggggtaaccccgggtaacccgtcggggttaccggggggggtaacccttaaaccggggggttaacccccg

SEQ ID NO: 337824 - DNA, 652 bp, Homo sapiens
  misc_feature: GZ8MTXP01BI64A.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctgggtggagtcgtgggggaggcctggtccgaggcccggggggtcctgagactctctgtggagcgtccggattcgacttgatacttattggatgagcgtgggtcccgccgaggcctccgagggggaggggcgtgggaggtggggtcggccacgaagtaaaggagatagggaagtgagtaacttcgtttggtcgggtctgtggtaggaacggggccgtattcgaacctatcctacccgaaggacgaaccaacgaccaaaggtaatccaacttgtatccgtgaactaaagttcggaaaacgtgttcggaggaaacggtacggtacgggaacgggaccgtacgggtcttaagggtaatttacgttttcggagggttcggacggggagggggacgcccggttgttaaggtcgggggttcccgaccgtttcggggaccgggggaaccgaaccgggggtaacccc

SEQ ID NO: 337825 - DNA, 530 bp, Homo sapiens
  misc_feature: GZ8MTXP01EZWN0.10.85.H08.1.454.CMB.2.raw
  modified_base (329)..(329): a, c, t, g, unknown or other
  misc_feature (329)..(329): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (530)..(530): a, c, t, g, unknown or other
  misc_feature (530)..(530): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaagggctggagtgggtggccaccataaaggaagatggaagtgagaactactttgtgggctctgtgaagggccattcaccatctccagagataacgccaagaagtcactgtatctgcaaatgaaacgatgtgagagtcgaggacacggctgtatatttctgtgcgaggggganccggctatggtcgacctcgtggggccaggggaaccctggtcaccgtctcatcagccctccacgacgggcccatcgtctcccctgccgccctgctccaggacgccacctccgaggacgcacacgccggcccgtggctcgcctggtacaacggctaactcccactaccttagtcgcttgngcgggntggcaggcgcaagttgn

SEQ ID NO: 337826 - DNA, 741 bp, Homo sapiens
  misc_feature: GZ8MTXP01DIOU4.10.85.H08.1.454.CMB.2.raw
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaaggtgtccaatgtgaggagcagctggtggaggtcgtgggggagcctggtccgaggccggggggtcctgagactctcctgtggagcgtccggattcgacttgatacttatggatgagcgtgggtcccgcaggctccgagggggagggctgggagtgggtgccacaagtaaaggagagtggaaagtgaagtaacttaactttggtgggctcgtggtaggaaacggggtccgtagtttccaacctattcctaccgaaggaacgaaaccgaaaaccgcccgaaaaggtaaacgttccaacgttggttaaacttccgttaaggggaacctaaaaaaggttcgggaaaaccgtagttagggtaccggaaagggtaaacgggttccggaacgggtaaaccgtaaccgggggttcctttaagggtttaaacttttggtttttaccggttgggttaggggaccgggggttaaacgggggggttcttccccgggggtaacttttaagggtccgggggttttacccggacccccggttggggttaaccccggggggaacccgtaaaaccccgggggg

SEQ ID NO: 337827 - DNA, 622 bp, Homo sapiens
  misc_feature: GZ8MTXP01AXBG2.10.85.H08.1.454.CMB.2.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (477)..(477): a, c, t, g, unknown or other
  misc_feature (477)..(477): n is a, c, g, or t
  modified_base (502)..(502): a, c, t, g, unknown or other
  misc_feature (502)..(502): n is a, c, g, or t
  modified_base (592)..(592): a, c, t, g, unknown or other
  misc_feature (592)..(592): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcgtggtttctgttagttatttagaagtgtcaatgtgaggagcagctgggtggagtcgtgggtgggcgtcgtcggtcggacgggggtcccggggtcngacgtctctcgtggtaggngtccgtgtagtactacacttatagtaagttagttaagtacgactagtacgtaccggtccgggccccaccggacggtccgtacggggaagggggacgggttcggtaggggttagggtttcggttataagttattagtagtaagtaaacgtaagttagggacgtaaaactattaactagtagacgtacgacgtactggtagggtacgggacggtacctntaccgactcttaccgacgaagacanacgtacgacgtaagtactacgtattagagtagtaagaatacggaaatgtcggagacggcgaacggaacgcgacttctctaattcgttagngcgacgaacgaaccgtaagagtcgaactaa

SEQ ID NO: 337828 - DNA, 588 bp, Homo sapiens
  misc_feature: GZ8MTXP01BY4FR.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccgaggccgggggggtcctgagactctctgtggagcgtccggattcgactttgatactattggatgagcgtgggtccgcaggctccgagggagggctggagtgggtggccacgataaaggagagtggaagtgagtaacttacgtttggtgggctcgtggtgaaggggcccattcacctatcctccagagacaacgccaaagacgtcactgtatctgacaaatggaacgtagtgtagagaggtcgaggacgacggtcttgtattattcgtggttggcggaggggacgcccgggttgttggttcggggtttaaccgggacccgttcggtcggggggcccttaacgggggtaaccccgttcgggtaaccccg

SEQ ID NO: 337829 - DNA, 599 bp, Homo sapiens
  misc_feature: GZ8MTXP01E2DJ6.10.85.H08.1.454.CMB.2.raw
  modified_base (439)..(439): a, c, t, g, unknown or other
  misc_feature (439)..(439): n is a, c, g, or t
  modified_base (598)..(598): a, c, t, g, unknown or other
  misc_feature (598)..(598): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaagggctggagtgggtggccaccataaaggaagatggaagtgagaactactttgtgggctctgtgaagggccgattcaccatctccagagacaacgccaaagagtcactgtatctgacaaatgaacgatgtgagagtcgaggacacggctgtattatttcgtgtgcggaggggacgccggatagtggttccggacctcggtcggggacagggaccctggtaccaccgtctcatcgacgtccctaccaaccgaacgggcccctagtccggtcccttcccccgnggcccgtcccctcgcctaccgagggactccgacccgtccgaacgggacgccaacgacggccggcccgtgggcctcgccgtggtaccgaacggtacctaaccgtcccactacttagtcgcgttcggcggcgggctcggcgaacggcgactaacgttaagng

SEQ ID NO: 337830 - DNA, 649 bp, Homo sapiens
  misc_feature: GZ8MTXP01BJIAT.10.85.H08.1.454.CMB.2.raw
  modified_base (558)..(558): a, c, t, g, unknown or other
  misc_feature (558)..(558): n is a, c, g, or t
tcagcatagtagtgcacgaccggtgctcgatttagtatcactcagtcgcgggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagcctggtccaggccggggggtcctgagactctcctgtggagcgtccggattcgacttgatacttagttggatgagcgtgggtccgccaggctccgaggggaagggctgggagtgggtgccacaagtaaaggagagtaggaagtagaagtaactacgtttgggagggtcttgtggtagggaaacggggtcccgtagtttaccaaccctattccctacccgaagaacgaaacccaaacgacccaaagtaactccaacgttagtataccgtagaacctaaaattcggaaacgtagtggtagaaggacggtacggaaggaccgacgggtctaggttaactttagttttcgngggttacggacggggagggggaccgcccgggttagttaacgttcgggggttcccacggttcggttacgggggcccaacgggggtaaccccg

SEQ ID NO: 337831 - DNA, 719 bp, Homo sapiens
  misc_feature: GZ8MTXP01CRMCL.10.85.H08.1.454.CMB.2.raw
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagcgtggtttcgtgtagttatttagaagtgtcatgtgagagcagctggtgagtcgtgggggagccgtggtccgaggccggggggtcctgagactctccgtggtggagcgtccggattcgacttgatacttatggatgagtctgggtccgccgaggctccgaaggggaggggctggagtggggtcggaccaacaagtaaaggaagagtagggaaagtggaagtaaacgttaacgtttgggtggggtcctgtagggttaggaaacggggtcccgtaagttccacctagttcctaccgaaggaacgaaccgaaacggacccaaaagggtaacgttaccaaacttggtaaacttccgtaggggaacctaaaaagttggaaaccgtaagttgggtagtaacggaagggttaccgggaaagggaaccccgaaacggggttacttaaggtttaacgtttacgttttcggttagggtacggggtacggggaacgggggttacgttccccggggttaagttaacgggttccgggttacccgggtaccggttccggggtaaccgggggaacccggtaacggg

SEQ ID NO: 337832 - DNA, 619 bp, Homo sapiens
  misc_feature: GZ8MTXP01BEQ5U.10.85.H08.1.454.CMB.2.raw
  modified_base (383)..(383): a, c, t, g, unknown or other
  misc_feature (383)..(383): n is a, c, g, or t
  modified_base (467)..(467): a, c, t, g, unknown or other
  misc_feature (467)..(467): n is a, c, g, or t
  modified_base (484)..(484): a, c, t, g, unknown or other
  misc_feature (484)..(484): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggagcctggtccgagggccggggggtcctgagctctctgtggagcgtccggattcgacttgatacttatggatgagcgtgggtccgcgaggctccgaggggaagggctgggagtgggtcgcccaacaagtaaaggagagtagggaagtgaagtaacttaacgtttggngggtctcgtggtagaacggggccatttccacccatcctaccgaagacgaacctaaacgaccaaagaacgtcaacgttgtaatcnggaacaaagtgaaacgngtggtagagacggtcgaaggacacgggtcttaagtaatttgttcgttagggtcggacggggaagggggcgccccgggtaattagggtcggggtttcgggaccctttcgggggtaacgggggccccgtaaaggggg

SEQ ID NO: 337833 - DNA, 634 bp, Homo sapiens
  misc_feature: GZ8MTXP01EH3D7.10.85.H08.1.454.CMB.2.raw
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
tcagcatagtagtgcacgaccggtgctcgatttagtatcactcagtcgcggggagagaggagccttagccctggactccaaggcctctccacttggtgatcagcactgagcacagaggactcacatggaattggggctgagtcttgggttttcttgttgttatttagaaggtgtcaatgtgaggagcagcgtgggtggaggtcggtgggggaggccgtgggtccgacgggcccgggggggtccctggagtctcgtccgtggtggaggtcgtcggattcgtactttgattactatggatgagcgtgggtccgcgaggctccgaggggaggggctgggagtgggtcgccaacgaagtaaaaggagagtaggaagtagagtaacttacgtttggcgggtacttgtggtggaaacgggccgtattcgaacctatcctaccgagaacgaacaacgaccaaaggtaaactctactgtaactctagaacaaagtggggaaacgtagtggtagagagtcggaaggaaccnggtcttagtattntttcgnggttcgggacggaaggggcgccgttacgttggttccggggttaaccgaccgtcgggtcggggacccttaacgggggtaacccttgggtaaccc

SEQ ID NO: 337834 - DNA, 655 bp, Homo sapiens
  misc_feature: GZ8MTXP01ELP3U.10.85.H08.1.454.CMB.2.raw
  modified_base (572)..(572): a, c, t, g, unknown or other
  misc_feature (572)..(572): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattgggctgagcgttggttttccttgttgttattttagaaggtgtcaatgtgaggagcagctggtggaggtcgtggggggagccgtggtccgagggcccggggggtcctggagctctcctgtggagcgtccggattcgacttgattacttagtggatgagcgtgggtccgcgaggccgtaccgaagggggaagggcgtgggaggtggggtcggacccacgaaagtaaagggagagtagggaaagttggaaagtaaccgtttaacgtttgggtggggtcttcgtaggttacggaacggggtccgtaatttcccgaaccctagttaccacccgaagaacgaaaccaaccggaaccaaagtaacgtctaactgtaactcctaaggggaactaaaagttgaaacgtagtggtagagaacgggtcgaaggagtaccggtnttaagttattgttcgttggtcggacgggagggttcgcggtaagtggttcggtccggtaccgttcgggtaacgggccgtaacgg

SEQ ID NO: 337835 - DNA, 606 bp, Homo sapiens
  misc_feature: GZ8MTXP01AOWC6.10.85.H08.1.454.CMB.2.raw
  modified_base (493)..(493): a, c, t, g, unknown or other
  misc_feature (493)..(493): n is a, c, g, or t
  modified_base (531)..(531): a, c, t, g, unknown or other
  misc_feature (531)..(531): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtgggtccaggccgggggggtccctgagactctcctgtggagcgtccggattcgacttgattacttatggatgagcgtgggtccgccgaggctccgaggggaggggctgggagtggggtgccacgagtaaaggagagtaggaagtgagaacttaacgtttggtgggctcgtggtaggaaggggccgtatttccgacctagttcctccgaagacgaacaacggaccaaaggaacgtcacgtgtactccgtaggactaaagtcgaaacgtatgngagagtcggaaggacacgggcttggtaattgttttcgnggtcggcgggaggggcgccggtaattaggttccgggttccggaccgttcggggtccgggggaacccgtaacgggg

SEQ ID NO: 337836 - DNA, 539 bp, Homo sapiens
  misc_feature: GZ8MTXP01B8ZN5.10.85.H08.1.454.CMB.2.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcgtggtttcgtgtaggtatttagaagtgtcatgtgaggagcagctggtggagtcgtgggggagcctggtccaggccggggggtccctgagactctctgtggagcgtccggattcgactttgatactattgatgngcgtggtcccncaggctaccggaggggaacgggngtggtaggtgggtcggccgaccgaagaaaggaagagtacggaggtagagtaatattagtggtcgtgtgtggaggacgactcacatcaccaganacacgacaagaganacatanananagaanagagagtgtagagagagacgtacgacgtgtgtaatgttgtgnggtacggngggcggcgttcgtgtcggtcggtcggtcggttcgggtcggttaacggtaaccgg

SEQ ID NO: 337837 - DNA, 651 bp, Homo sapiens
  misc_feature: GZ8MTXP01DYGI0.10.85.H08.1.454.CMB.2.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattgggctgagctgggttttccttgttgttattttagaaggtgtccaatgtgaggagcagctggtggagtcgtgggggaggcctggtccgaggcccggggggtcctgagactctcctggtggagcgtccggattcgactttgatacttatgatgagctggtcncaggctcgaggggaggntggagtgggtgccacaagtaaagganagtcggaagtgaagtaacttacgtttggtgggtctcgtagggtaggaacggggcccgatttccgaacctaattccgtacccaaggacgaaccaaacgaccaaagtaacgtccaacttgtaatcgtagactaaagtggaaacgtatggngaagacgtacggaggaactacggtnttagttaatttagtttcggtagggttcggaacgggggtaagggggccgttcccgggttagtttaagggttcccgggggttaacccggacccggttcggggttaccgggggtaaccccgttaaaccgggggtaacccccg

SEQ ID NO: 337838 - DNA, 543 bp, Homo sapiens
  misc_feature: GZ8MTXP01DONSE.10.85.H08.1.454.CMB.2.raw
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccggggggtccctgagactctctgtggagcgtccggattcgacttgatactattggatgagctgggtccgcaggctccgagggaagggctgggagtgggtgccacataaaggagatggaagtgagaactacgtttggngggctcgtggtagaacgggccattcaccatctcaganacaacgccaaaggaatcactgtatctgacaaatgaaacgntggtgagngtacgnggacacggtntgtaattnttgtgttggcggaggggcgttcggagtggtcgggtccgcgtcggttacggggtcccgaacggggtaacccg

SEQ ID NO: 337839 - DNA, 655 bp, Homo sapiens
  misc_feature: GZ8MTXP01ECXGU.10.85.H08.1.454.CMB.2.raw
tcagcatagtagtgcacgaccggtgctcgatttagtatcactcagtcgcggggctcagagaggagccttagccctggactcaaaggcctctccacttggtgatcagcactgagcacagaggactcaccatggaattggggctgagctgggttttccttgttgttattttagaaggtgtccaatgtgaggagcagctgggtggagtcgtgggggaggccgtggtccgaggccggggggtccctgagactctcctgtggagcgtccggattcgactttgatacttattggatggagcgtgggtccgccaggcctccgaggggaaggggctgggagtgggtggccaacgaagtaaaggaagagtagggaagtagaagtaacttacgttttgggtgggtcttcgtgggtagggaaacgggggtcccgtaagtttcccaacctattcctacccgaaggaacgaaccaaacgacccgaaagaacgtcactgtaatcgtagacaaagtgaaacgtagtgtagagaggtacggaggaccacgggtctggttaattatttcgtggttggaccggggtaaggggggacgttcccgggttagttaacggttcgggttcccgggaccgttcggggttacgggggaacccttaacgggggtaaccccg

SEQ ID NO: 337840 - DNA, 649 bp, Homo sapiens
  misc_feature: GZ8MTXP01AHMHJ.10.85.H08.1.454.CMB.2.raw
  modified_base (307)..(307): a, c, t, g, unknown or other
  misc_feature (307)..(307): n is a, c, g, or t
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
  modified_base (526)..(526): a, c, t, g, unknown or other
  misc_feature (526)..(526): n is a, c, g, or t
  modified_base (544)..(544): a, c, t, g, unknown or other
  misc_feature (544)..(544): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggagcctggtccgaggcccggggggtcctgagctctctggtggagcgtccggattcgactttgattacttagttggatgagtcgtgggtcccncaggctccgaggggagggctgggagtgggtcgccacgaagtaaaggaagagtaggaagtgaagtaacttacgtttggngggtctcgtggtaggaaacggggtcctaattccgaccctatccctacccgaaaggacgaaccaaaccggcccaaaagacgtcaacgttgtaactctagactaaatggaaacagttgngagacgtacggacggaccacggtnttggttaattattttcgnggttcggaccgggaagggggacgttcccgggttattaacggttcggggtttaacccgggacccgttcggggttaccgggggaacccgaacgggggttaacccccg

SEQ ID NO: 337841 - DNA, 649 bp, Homo sapiens
  misc_feature: GZ8MTXP01BYTIH.10.85.H08.1.454.CMB.2.raw
  modified_base (301)..(301): a, c, t, g, unknown or other
  misc_feature (301)..(301): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggcccggggggtcctgagactctcctgtggagcgtccggattcgactttgatacttattggatgagcgtgggtcccncaggcctccggaggggaaggggctgggaggtgggtcgccacagtaaaggagagtagggaagtgaacgtaaacttcgtttagggtcgggtctgtggtagggaaacgggccgtaattccgaacctatcctaccgaagacgaaccaacgacccgaaagtaacgtcaacgttgtaactcgtagaactaaagtggaaacgtagttggtagaggaacgtacgggaggtaccacgggtcttaaggtaatttacgtttgtggttggcgggtaagggggcgccgggttcttaaggttcggggtttaacccggacccgttcgggttcgggggaaccccgttaacgggggtaacccccg

SEQ ID NO: 337842 - DNA, 686 bp, Homo sapiens
  misc_feature: GZ8MTXP01DC415.10.85.H08.1.454.CMB.2.raw
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (375)..(375): a, c, t, g, unknown or other
  misc_feature (375)..(375): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagcgtggtggagtcgtgggggaggccgtggtccgaggcccggggggtccctgagactctcgtggtggagcgtccggattcgacttgatactatggatgagcgtggtccgcaggctcgaggggagggntggagtgggngccacgaagtaaaggagagtggaagtgaagtaacttacgtttggngggtctcgtgggtacgggaaacggggccctagtttcaaccctattcctaccaaggaacgaaaccaaacggaacccaaaggtaacgtaccaacgttagtaactcgtacggactaaaaagttcggaaaacgtagttaggtagggaaagtacgggtaccggaaggggtaaccaccggggtactttggtttaaatttgttttaccggtggttacgggtaccggggaggggggaccgttcccgggttacgtttaagggttcggggttccggacccggttcgggttacgggggtccccgttaacggggtaaccccgg

SEQ ID NO: 337843 - DNA, 598 bp, Homo sapiens
  misc_feature: GZ8MTXP01EZ3UM.10.85.H08.1.454.CMB.2.raw
  modified_base (393)..(393): a, c, t, g, unknown or other
  misc_feature (393)..(393): n is a, c, g, or t
  modified_base (503)..(503): a, c, t, g, unknown or other
  misc_feature (503)..(503): n is a, c, g, or t
  modified_base (530)..(530): a, c, t, g, unknown or other
  misc_feature (530)..(530): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcgttgggttttccttgttgttattttagaaggtgtcaatgtgaggagcagctggtggagtcgtgggggagccgtggtccgaggccggggggtcctgagactctctgtggagcgtccggattcgactttgattacttagttggatgagcgtgggtcccgcgaggctaccggaggggagggggctgggaggtggggtcggccaacgaagtaaaaggaagagtaggaagtagaagtaacttacgtttgggngggtctcgtaggtagggaaacgggtccgtattcaacccagttccacgaagacgaaccaacgtaccaaagtaacgtccaacttgtaactcgtagaacaaaagtcgaaacgnttggacgaggtagacggagacacggtntgtaattgttgngcggnggagggngcggttntggtcggtcgacgtcgggacgggtccgaacgggtccc

SEQ ID NO: 337844 - DNA, 693 bp, Homo sapiens
  misc_feature: GZ8MTXP01BMFQE.10.85.H08.1.454.CMB.2.raw
  modified_base (301)..(301): a, c, t, g, unknown or other
  misc_feature (301)..(301): n is a, c, g, or t
  modified_base (537)..(537): a, c, t, g, unknown or other
  misc_feature (537)..(537): n is a, c, g, or t
  modified_base (572)..(572): a, c, t, g, unknown or other
  misc_feature (572)..(572): n is a, c, g, or t
  modified_base (615)..(615): a, c, t, g, unknown or other
  misc_feature (615)..(615): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggccgtggtccgagggccggggggtcctggagctctcctgtggagcgtcggatcgacttgatacttagtgatgagcgtgggtccncgaggctccgagggggaggggcgtgggaggtggggtcggaccacgaagtaaaggaagtacgtagggaaagtggaagtaacttaacgtttgggtggggcttcggtgggttacgggaaacggggtcccgtaattccacccgtattccctacccgaagaacgaaccaaaccggaccaaaggtaacgtcaaacgttggtaattcctaggggaactaaaagttcggaaaaccgtagttggngaaaggtacggtaccgggaagggtacgaccgggtntaagttaattacgttttcgagggtcgggacgggaacggggggngttccccggggaagttttaagttccgggggtttacccgggaccgtttccggggtaacggggggccctaaaacgggggg

SEQ ID NO: 337845 - DNA, 634 bp, Homo sapiens
  misc_feature: GZ8MTXP01CVILM.10.85.H08.1.454.CMB.2.raw
  modified_base (379)..(379): a, c, t, g, unknown or other
  misc_feature (379)..(379): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtgggtccgaggcccggggggtccctgagactctcctgtggagcgtccggattcgactttgattactattggatgagcgtgggtcccgcgaggctccgaggggaggggcgtgggagtgggtgacccacgagtaaaggagagtggaagtgagtaacttcgtttggngggtactgtggtaggaaacgggtccgtattccacctatcctaccaagacgaacaacgaccaaagagtccactgtatctagacaaagtggaaacgtagtggtagaaggtagtcggaaggaccacgggtcttagttaattatttcgtaggttggaccgggaggggtacgtcccgggttagtttacggttccggggtttaaccggacccgtttcgggcgggggacccttaacgggggttaacccgttgggtaaccccg

SEQ ID NO: 337846 - DNA, 607 bp, Homo sapiens
  misc_feature: GZ8MTXP01AME0A.10.85.H08.1.454.CMB.2.raw
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (472)..(472): a, c, t, g, unknown or other
  misc_feature (472)..(472): n is a, c, g, or t
  modified_base (522)..(522): a, c, t, g, unknown or other
  misc_feature (522)..(522): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggagcctggtccgaggcccggggggtcctgagactctcctgtggagcgtcggattcgactttgatacttattggatgagctgggtccncaggctcgaggggaggctggagtggtgccacagtaaaggagagtggaagtgaagtaacttacgtttggngggtctcgtaggtggaacgggccgaattccaacctatctacccgagacgaaccaacgaccaaagactcacttgtatcgtagacaaagtcggaaactagttcggngaacggtagtaccggaggtaaccacgggtctaggttaacttattttcggnggttagggacgggaaggggttcgccggttagttaaggtcgggttccggaccgttcgggaccggggtaacccgaacgggtaacccc

SEQ ID NO: 337847 - DNA, 854 bp, Homo sapiens
  misc_feature: GZ8MTXP01CCUES.10.85.H08.1.454.CMB.2.raw
tcagcatagtagtgcacgaccggtgctcgatttagtatcactcagtcgggggctgggaggcctggtccaggccgggggggtccctgagactctcctgtggagcgtccggattcgacttttgatacttattggatgagctgggtccgccaggctccgagggaagggctggagtgggtgccacataaaggagatggaagtgagaacttacgtttggtgggctcgtggtaggaaacgggcctattcaaccatcctaccaagagacaacgccaaagaagtcactgtatctgacaaaatgaaacgatggtagagagtcgaaggacacggctagtatatttcgtggtggacggagggggacgccgggtacttaggtcgggttccggaccgttccggtacggggggaccaacgggggtaaacccccttggggtaacccaacccggttctacaacgttccgacggcccctacccgaaacccgtaaacgggcccctaacgttcccgggttccccttccccccggtgggccccgtcccccgtcggtacccgttaccccggaacgggaccgtaccccgtaaccccgttaccccgggaaagggggaacccggacccgaaacccggtacccggggccccggggacccccggtttcggggggaccctttcccggggtaccccggtttaccgggggttaaaccccgaaaaccggggttaaacccctttaaacccccttttaacccccggaaaccgttttaaaccccgttaagttcccggggtaacccgtttagggggaacccggggcccggggggttccttaccgggggaaccggaaaccggggtcccggaactaaacggttaacggcg

SEQ ID NO: 337848 - DNA, 692 bp, Homo sapiens
  misc_feature: GZ8MTXP01B4OND.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggcctggtccgaggccggggggtcctgagactctcctgtggagcgtccggattcgactttgatacttattggatgagcgtgggtccgcaggctccgaggggaaggcgtgggagtgggtgccacagtaaaggagataggaagtgagtaactagtttggagggctcgtggtagggaacggggtcccgtattccgaaccctattccgtaccaaggacgaaccaaacgaccaaaagaagtcacgttagtaacttcgtacggaacaaaagttcggaaacgtagtaggttacggaaggaacggttacgggaaacggtaacggaaacccggggtttcgtttaaggtttaatttacgttttcggtagggttacggggtacggggtaacgggggttaccggttccgggttacggttaacgggttccggggttcccggtacccggttcggggttaccgggggaaccccggttaacggggtaaccccg

SEQ ID NO: 337849 - DNA, 632 bp, Homo sapiens
  misc_feature: GZ8MTXP01AOUMX.10.85.H08.1.454.CMB.2.raw
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
  modified_base (511)..(511): a, c, t, g, unknown or other
  misc_feature (511)..(511): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggagccgtgggtcccgaaccggggggtccctggagctctcctgtggagcgtccggattcgactttgatacttattggatgagctgggtccnccaggctccgagggggaaggggctgggacgtggggtgcccgaaccgaagtaaaggaagagtggaaacgtgagaacttacgtttggngggtctgtggtagaaggggtccctaattcgaactatcctaccaggacgtacaacgccaaagaacgtcactgtattcagacaaagtgaacgtatgtagagacggtacggaaggacaccgggttnttagttaattcgtttgttgggtcggacgggtacggggacgttccgggttacgttacgggttcggggttccggtaaccgttcggggaccgggggttaccgtaaccggggttaacccgtcggg

SEQ ID NO: 337850 - DNA, 524 bp, Homo sapiens
  misc_feature: GZ8MTXP01AZUZ0.10.85.H08.1.454.CMB.2.raw
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagcgtggtttctgtgttatttagaagtgtcaatgtgaggagcagctggtggagtcgtgggggagcctggtccaggccggggggtcctgagactctcctgtggagcgtccggattcgactttgatacttagttgatgagctgggtccncaggctccgagggagggcgtggagtgggtggccacagtaaaggagatggaagtgagaactagtttgngggctanggtgaacgggcagttcacattcacaggacanaacgcaagagtcagttntatnagacaagtganagtgagagngtcgaagacncgtnttgtaattgttgngnggacggagggcggcggcgtgtcggtcggtcgtcggttcgggtcggaacggtaaccg

SEQ ID NO: 337851 - DNA, 697 bp, Homo sapiens
  misc_feature: GZ8MTXP01B9G4I.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgaggcccggggggtccctgagactctccgtgtggagcgtccggattcgactttgatacttattggatgagcgtgggtcccgccaggctccggagggggacgggggctgggaggtggggtcggccaaccgaagtaaagggagtagtagggaagtgaagtaacttacgtttggtgggcttcgtggtgggaaacggggcctaattccacctatcctaccgaagacgaaccaaaccggaccaaaggtatccacgttgtactcgtagactaaaagtggaaacgtagttggtaggaaggtaggtaccgggaaggtaacccgtacggggtccttagggttaactttagttttcggtagggttcgggaccggggtaaggggggttccgccccggggttattaaggggttcccgggggtttaaccgggtaccccggttcgggttaccgggggggtaaccccgttaacggggggttaacccccg

SEQ ID NO: 337852 - DNA, 556 bp, Homo sapiens
  misc_feature: GZ8MTXP01BH9K8.10.85.H08.1.454.CMB.2.raw
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (468)..(468): a, c, t, g, unknown or other
  misc_feature (468)..(468): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (517)..(517): a, c, t, g, unknown or other
  misc_feature (517)..(517): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccgggggggtcctgagactctcctgtggagcgtccggattcgactttgatacttatggatgagctgggtccncaggctccgaggggagggctgggagtgggtggccacgaataaaggagatggaagtgagtaactacgtttggngggctcgtggtaggaacggggcccgtattccaacccgtatcctaccaaggacgaaccaacgccaaagtacgtcactgtaatctgacaaatggaacatgngacgagtcgagactacggntgtaatnttgngnggcggagggcgcggttntaaggtcgggtccgcgtggcgggccgaacgggtaacccg

SEQ ID NO: 337853 - DNA, 699 bp, Homo sapiens
  misc_feature: GZ8MTXP01DKO86.10.85.H08.1.454.CMB.2.raw
  modified_base (370)..(370): a, c, t, g, unknown or other
  misc_feature (370)..(370): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgagagcagctggtggagtcgtgggggagcctggtccgaggccggggggtccctgagactctcctgtggagcgtccggattcgacttgatactatggatgagcgtgggtccgcaggctccgaggggaaggggctggaggtgggtgcccaacgagtaaaggagagtggaagtgagaacgttacgtttggngggtcttcgtggtaggaaacggggcccgtattcccaacctacttccctacccgaagaacgaaccaaaccgaccgaaaggaaacgtctaacgttagtacttaccgtaggaactaaaagttaggggaaacgtagttaggtaggaaggtacggtaccggaaggaaccgacgggtccttaggttaattttacgttttcgtgggttgggaccggggaaggggggtaccgtcccggggttaacgtttaggttccgggggtttaacccgggtaacccgttcggggttaccgggggacccgttaacgggggtaaccccccgtttggggttaaccccg

SEQ ID NO: 337854 - DNA, 670 bp, Homo sapiens
  misc_feature: GZ8MTXP01ERJES.10.85.H08.1.454.CMB.2.raw
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (587)..(587): a, c, t, g, unknown or other
  misc_feature (587)..(587): n is a, c, g, or t
  modified_base (593)..(593): a, c, t, g, unknown or other
  misc_feature (593)..(593): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggtttccttgttgttatttagaaggtgtccaatgtgaggagcagctggtggagtcgtgggggagccgtgggtccgagggcccggggggtcctgagtactctccgtggtggacgcgtccggtattcgtactttgatacttagttggatgagcgtgggtcccncgnggctccggagggggagggcgtgggaggtcggggtcggaccaacgtaagtaaacgggaagagtacgggaaggtaggaacgtaacgttacgtttgggtggggtcttcgtagggtacgggaacgggggtccctaagttccaaacctactccgtaccgaaggacgaaccgaacgaccgaaaagtacgtccaacgttgtactacgtacgaacgtaaaagttacggaacgtaagtgtaggaacgtacggtacggaggacgtacggtcttaggtaattntttcgnggttaggcgggagggcgccggttacgtaagttccggtcggacccgtgggttacggggccgttaacgggggtaacccg

SEQ ID NO: 337855 - DNA, 681 bp, Homo sapiens
  misc_feature: GZ8MTXP01D990J.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgaggccggggggtcctgagactctcctgtggagcgtccggattcgacttgatacttattggatgagcgtggtccgccaggctccgagggaagggctgggagtgggtcgccacgaagtaaaggagagtacggaagtgaagtaacttacgtttggtagggtctcgtggtagggaacggggtcccgtatttccgaaccctagttccgtacccgaaggaacgaaccaaacgtacccaaaggaacgttcaacgttgtaattaccgtagaactaaaagtcggaaacgtatggtagaggtagtaccggaaggtaaccgacggtcttagggttaaattgttttcggtggttacgggaccggggtaagggggaccggttcccgggttacgtttaagggttcggggtttaacccgggaacccttcgggttacgggggaaccccgttaaacgggggttaacccccg

SEQ ID NO: 337856 - DNA, 690 bp, Homo sapiens
  misc_feature: GZ8MTXP01DVZ6N.10.85.H08.1.454.CMB.2.raw
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagccgtggtccgaggccggggggtcctgagactctctggtggagcggtcgattcgacttgatacttatggatgagcgtcgggtccgccgaggctccggaagggggaagggggcgtaggggagggttgggggtcggacccaaaccgaaagtaaaagggaagaagtagggaaagtggaagtaacgtttaacgtttgggtcggggtctcgtagggtacgggaaacggggtcccgtagttaccaacccgtacttaccgtacccgaaggaaccgaaacgaaaaccgaccaaagtaacgtcaacttggtaacttcgtaggaactaaaagttacggaaagtagttggtagaaggtaaacggtcggaaaggtaccaacgggttcttaagttaagttatttcggnggttacggngggttagggggcgttccggaattaggtcggggttaccggcccgttagggtccgggggcccgtaaccgggg

SEQ ID NO: 337857 - DNA, 597 bp, Homo sapiens
  misc_feature: GZ8MTXP01B78S8.10.85.H08.1.454.CMB.2.raw
  modified_base (471)..(471): a, c, t, g, unknown or other
  misc_feature (471)..(471): n is a, c, g, or t
  modified_base (498)..(498): a, c, t, g, unknown or other
  misc_feature (498)..(498): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagcgtggtggagtcgtgggggaggcctggtccgaggcccggggggtccctgagactctcctggtggagcggtccggattcgactttgattacttattggatgagcgtgggtccgccaggctccgaggggagggctggaggtgggtcgccacgagtaaaggagagtggaagtgaagtaactacgtttggtgggctcgtggtggaagggcctattccacctatctaccgagacgacaacgaccaaaggaacgtcactgtactctagactaaagtgaaacgntggtagagagtacggaggacacgggtntgtaattagtttcgtgttggacggagggggacgcccgggttagttaagttcggggttccgggacccgtcgggttcgggggccccaagggggtaaccccg

SEQ ID NO: 337858 - DNA, 593 bp, Homo sapiens
  misc_feature: GZ8MTXP01BRVGM.10.85.H08.1.454.CMB.2.raw
  modified_base (364)..(364): a, c, t, g, unknown or other
  misc_feature (364)..(364): n is a, c, g, or t
  modified_base (502)..(502): a, c, t, g, unknown or other
  misc_feature (502)..(502): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttatttagaggtgtccaatgtgaggagcagctggtggagtcgtgggggaggcctgggtccgaggccgggggggtccctggagactctcctgtggagcgtccggattcgactttgatactatggatgagctggtccgcaggctccgagggaggggctggagtgggtgccacagtaaaggagatggaagtgagtaactacgtttggngggtacttcgtggtgaaaggggccgtattccaacctatcctaccaagacgacaaacgaccaaagaagtcactgtaatctagactaaaatgggaaacgattggtagagaggtcgaaggacacggtctagtatatttcgnggttgcggagggggagccgggcgttagttcggggttcggacccgttcgggcgggggtacccgaacgggggtaaccccgttggggtaacccc

SEQ ID NO: 337859 - DNA, 638 bp, Homo sapiens
  misc_feature: GZ8MTXP01CRU5U.10.85.H08.1.454.CMB.2.raw
  modified_base (239)..(239): a, c, t, g, unknown or other
  misc_feature (239)..(239): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
  modified_base (564)..(564): a, c, t, g, unknown or other
  misc_feature (564)..(564): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggccggggggtcccngacgactctctggtggagcggtcggattcgtactttgatacttatggatgagcgtgggtccgccgaggccgtccgagggggaaggggcgtgggaggtggggtggaccacgaaagtaaaggaagagtacggaaggtagaagtaacttacgtttgggngggtctcgtgggtagggaacggggccagtttcaaacccgtntcctacccgaagacgaaccaaacggaccaaaaggaacgtccaacgtgtaatacgttagaactaaaattcggaaactgtaggtagaagtaggtaccggaagtacgaggtcttggtaaattcgttgtggngtacgggagggggacgttcccggagttaacggtggttaaccggcctgggttcgggaaccgaacgggtaaccccg

SEQ ID NO: 337860 - DNA, 617 bp, Homo sapiens
  misc_feature: GZ8MTXP01AUVZ1.10.85.H08.1.454.CMB.2.raw
  modified_base (402)..(402): a, c, t, g, unknown or other
  misc_feature (402)..(402): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagcgtggttttcctgttagttatttagaaggtgtcaatgtgaggagcagcgtggtggagtcgtgggggagcctggtccgagggccggggggtcctggagactctccgtggtggagcgtcggattcgtacttgatactatggatgagcgtcgggtccgccgaggccgtaccggaggggaacgggggctgggggaggttcgggggtacgacccaaacgtaaagtaaaagggaagagtaggaaagtagaagtaacttagtttggnggggtcttacgtggtacgggaaacgggtccgtacttccactactcctaccgaagaaacggaaccaaaccgttacaaagtacgtactactagtactcaggaactaaagtcggaaagtgttgagagtagcgaacggactggtattgtaacttgttcggnggnggnggnggcggcgttcgttcgttcggtcgtcgtcggcggcggacgtcgttcgtcg

SEQ ID NO: 337861 - DNA, 753 bp, Homo sapiens
  misc_feature: GZ8MTXP01CZC2W.10.85.H08.1.454.CMB.2.raw
  modified_base (406)..(406): a, c, t, g, unknown or other
  misc_feature (406)..(406): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcgtgggttttccttgttgttattttagaaggtgtccaatgtgaggagcagctggtggagtcgtgggggagcctggtccgaggccggggggtccctgagctctcctggtggagcgtccggattcgtactttgattacttagttggatgagcgtgggtcccgccgaggcctccgagggggaagggggtcgtggggaggtggggtcggaccaaccgaagtaaaagggagagtagggaaaggtgagtaaacgttacgttttgggngggtcttcgtggttagggaaacgggggccctatttccaaccctattccgtaccccgaaggaacggaaccaaaacccggaccgaaaaggtaacgttacccgaacttagttaacttaccgtaggaacctaaaagttaccgggaaacgtagtttacgggtaggaacgggtaggttaacccgggaaaggaaaccgtaccggggtactttaggttaaatttttacgtttcgttcggttggggaccgggggtaagggggccggttccggggttaccgtttaagggtttccgggggtttccggacccggttcggggttaccgggggaaccccgttaacgggggttaaccccccg

SEQ ID NO: 337862 - DNA, 589 bp, Homo sapiens
  misc_feature: GZ8MTXP01DLUAP.10.85.H08.1.454.CMB.2.raw
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
  modified_base (470)..(470): a, c, t, g, unknown or other
  misc_feature (470)..(470): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccgaggggaaggggctggagtgggtggccaccataaaggaagatggaagtgagaacttactttggtgggctctgtgaagggccattcaccatctcagagataacgcaagaagtcactgtatctgacaaatgaacgatggtagagagtcgaggacacggntgtatatttcgngtgcggaggggnccggntagtcgggtcgaccgtcgtcggggaccagggtacccctggtacccaccgttcncactcacgccctaccgacgaacgggccctacgttccggttcccttccccgtggtcccgccctcgcctccgagggaccnccaccgtcgaggacgcgacgcggccggccgtcggctcgtcgtcgtacgaacgtccttaacctcccttactacttcgtcgtcgttcggcggccggcgtcggaacgacggcactaagngng

SEQ ID NO: 337863 - DNA, 628 bp, Homo sapiens
  misc_feature: GZ8MTXP01BK95R.10.85.H08.1.454.CMB.2.raw
  modified_base (533)..(533): a, c, t, g, unknown or other
  misc_feature (533)..(533): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagcctggtccaggccggggggtcctgagactctctgtggagcgtccggattcgacttgatacttattggatgagtcgtgggtcccgcgaggcctaccgagggggaaggggcgtgggagtgggggtgaccacaagtaaaggagagtaggaagtgaagtaacttacgtttggacgggtctcgtagggtaggaacggggcctagttccaaccgattcctaccaaggacgaaccaaaccgaccaaagacgttcaacttggtactaccttaggaactaaatggaaaccgtatggtagaaggtacggtacggacggacgtaccgggtntggttaattatttcggtggttaggcgggtaggggacgcgggttacttggtcgggtccgtaccggtgggttaccggggtcgaaccggggtaacccg

SEQ ID NO: 337864 - DNA, 667 bp, Homo sapiens
  misc_feature: GZ8MTXP01BWWHM.10.85.H08.1.454.CMB.2.raw
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgacggcccgggggggtccctgagactctcgtgtggacgcgtccggattcgactttgattacttagttggatgagcgtgggtcccgcgaggcctccgagggggaaggggcgtgggagtgggggtcggaccgaaccaagtaaagggaagagtaggaagtgaagtaacttagtttgggtgggctcgtggtaggaacggggcctagttcaccntcnccagacacaacgacaagatcactgtatctagacaaagttgaaacgtatggtagaggtacggtacggaaggacgacgggtcttaggttaaattacgtttttcgtgggttacgggacgggggtacgggggttaacggttcccggggttacgtttaacgggttcgggggtttaacccgggaccccggttccggggttacggggggtaaccccgaacgggggggttaaacccccg

SEQ ID NO: 337865 - DNA, 646 bp, Homo sapiens
  misc_feature: GZ8MTXP01DWWHR.10.85.H08.1.454.CMB.2.raw
  modified_base (306)..(306): a, c, t, g, unknown or other
  misc_feature (306)..(306): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccgagggaaggggctggagtgggtggccaccataaaggaagatggaagtgagaactactttggtgggctctgtgaaggccgattcaccatctccagagacaacgcaagaatcatgtatctgacaaatgaacgatgtgagagtcgaggacacggtntagtattatttcgtgtgcggaggggacgccggtacttagtcggttccgaccgtccggcggggaccgaacgggtaccctggtaacccaccgtcacactccgacgtccctaccgaaccgaaccggtccctacgttcccggttcccgttccccgtcggcccgtccccgtcgccgtaccgacggaccgccacccgtaccgacggacgcgacgaccggccggtcccgtcggtaccgtcggtcccgttagggtaccgtaaacggtcccttaacccttacccttaacgttacttagtcgtcgttacggcgggccgggtcgtacgggaacgaacgggcgactaagngn

SEQ ID NO: 337866 - DNA, 719 bp, Homo sapiens
  misc_feature: GZ8MTXP01ETAIP.10.85.H08.1.454.CMB.2.raw
  modified_base (397)..(397): a, c, t, g, unknown or other
  misc_feature (397)..(397): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgaggcccgggggggtccctggagactctccgtggtggacgcggtccggattcgactttgatacttattggatgagcgtgggtccgccaggcctccggagggggaggggctgggaggtggggtcggccaacgaagtaaaggaagagtagggaagtagaagtaacttacgtttggngggtcttcgtggtagggaacgggcccgtattccaacctatcctaccgaagacgaaccaaacgtaacccaaaggtaacgtcaacgttgtaactcgtagaactaaaagttggaaacgtagttaggtagaaggtacggtaccgggaaggtaacccgtacggggtctttagggttaaacttttagtttttcggtagggttcgggtacccgggggaaggggggttcggttccccgggttacgtttaaggggttccgggggtttaacccgggaaccccggtttggggacccggggggtaaccccgttaaaccgggggttaacccccgg

SEQ ID NO: 337867 - DNA, 700 bp, Homo sapiens
  misc_feature: GZ8MTXP01CFOUI.10.85.H08.1.454.CMB.2.raw
  modified_base (617)..(617): a, c, t, g, unknown or other
  misc_feature (617)..(617): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagcgttgggttttccttgttgttattttagaaggtgtccaatgtgaggagcagctggtggagtcgtgggggagccgtggtccgaggccggggggtccctgagactctcctggtggacgtcggtccgtattcgtactttgatacttattggatgagtcgtgggtccgccgaggcctaccggaagggggacggggtcgtggggaggtcggggtcggacccaacgtaagtaaaagggagagttaggaaggtagaacgtaacgttacgtttagggtcgggtctacggttgggacgggtaacgggacccgttactaccgaaccctacgttcccgacgaaagggaaccgaaaccgaaacccggaaaccgtaaagaacggttcctaacgttgtaacttccgtaagaaacggtaaagtaccggaatagggtgaggagtacggacggagtaaccgtggtacttaggttaattcgtttggnggttcgggagggagggttaccgttcgggttcgttaaggttccggggtcgcggttacggggccggtaaccgccgggttaacccg

SEQ ID NO: 337868 - DNA, 673 bp, Homo sapiens
  misc_feature: GZ8MTXP01EX1N6.10.85.H08.1.454.CMB.2.raw
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (493)..(493): a, c, t, g, unknown or other
  misc_feature (493)..(493): n is a, c, g, or t
  modified_base (602)..(602): a, c, t, g, unknown or other
  misc_feature (602)..(602): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatgganaagagcctaacttgtggntcgtgtgaggccgantcaccatctccagagacaacgccaagaagtcactgtatctgacaaatagaacgatgtgagagtcggaggacgacggcgtgtnattatttcgtggtgcggagggggacggccggtcgtacgttgggttcggaccctcggtcggggccgaacgggaacccgtcgtccgaccgtcntcacntacacgcccgtccccaaccgaaccgggcccacgcttcccggttcccccgttcccccggtccggtccccgtccccgtcgtccccgnacccggacggaccgacccgtaccccgtaccggacggaccgaccgaccggaccgggccccgggtcccgggtccgggtccgttccggtccggttaccggtaaccggtcccncccgttaacccgttaccccgttaaccccgaacccttaaccgttacgtacgttcgtaacggccgggtccggg

SEQ ID NO: 337869 - DNA, 540 bp, Homo sapiens
  misc_feature: GZ8MTXP01AIYOY.10.85.H08.1.454.CMB.2.raw
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttcttgttgttatttagaaggtgtccaatgtgaggagcagctggtggagtcgtgggggaggcctgggtccgaggccggggggtcctgagactctctgtggagcgtccgattcgactttgatactatggatgagctgggtccgcaggctccgagggaggggctgggagtgggtggccacgagtaaaggagatggaagtgaagactagtttggngggcttntgtgaagggccattcaccatcctaccagagacaacgccaaagacgtcactgaatctgacaaatgggaacgatgtagagagcgaggacacgtntgtattnttngttgcggngggtagcgggttcttagttgggttccgacgtcgtggggccagggtaacccgttgggtaaccc

SEQ ID NO: 337870 - DNA, 544 bp, Homo sapiens
  misc_feature: GZ8MTXP01CD6RQ.10.85.H08.1.454.CMB.2.raw
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagccgtggtccgaggccggggggtcctgagctctctgtggagcgtcgattcgactttgatactagtggatgagcgtgggtcccgcgaggctccgaggggaggggctgggagtgggtcgaccacgaagtaaaggagagtggaagtgagacttacgttgngggctcgtggagaaacggggccatcacgntccncaaganacaacgtacaaaggaactccgatgtaancgtaagcaaagttgaacgtagtgtacgagagtcgaaggacacggtntgtatgttcgngnggcggagggcgcgngttgcggtcgcgtggcgggacgacggtcccgttggtcc

SEQ ID NO: 337871 - DNA, 598 bp, Homo sapiens
  misc_feature: GZ8MTXP01BMP15.10.85.H08.1.454.CMB.2.raw
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (496)..(496): a, c, t, g, unknown or other
  misc_feature (496)..(496): n is a, c, g, or t
tcagcatagtagtgcacgaccggtgctcgatttagtatcactcagtcgcggggagagaggatccttagccctggactccaaggcctctccacttggtgatcagcactgagcacagaggactcaccatggaattgggctgagctgggttttccttgttgttattttagaaggtgtcaatgtgaggagcagctggtggagtcgtgggggagcctggtccgaggccggggggtcctgagactctcctgtggagcgtccggattcgactttgatactatgatgagcgtggtccncaggctccgagggagggctggagtgggtgccacgagtaaaggagagtggaagtgaagaacttacgtttggngggcttcgtggtaggaaacggggcctattccactatcctcagacgacaacgccaaagaactcactgtancgtagaacaaatgggaaacgtntggtagagtagtcggaagaccgaggtcttagttattagtttcgnggttcgggcggttacgggggacgtcccgggttagttacggttcggggtttcccgaccgtcggggtcgggggacccacgggggtaaccccttggggtaacccc

SEQ ID NO: 337872 - DNA, 579 bp, Homo sapiens
  misc_feature: GZ8MTXP01C5R6G.10.85.H08.1.454.CMB.2.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (552)..(552): a, c, t, g, unknown or other
  misc_feature (552)..(552): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggagatggaagtgagaactactttgtgggctctgtgaagggccattcaccatctccagagacaacgccaaagaagtcactgtatctgacaaatgaaacgntgtgagagtcgaggacacggctgtatatttcngtgcggagggggagccggcttagtcgggttcggaccttcgtcgggggaccaggggaacccctggtacccaccgtctcatcacgccctccgaaccgaacgggcccagtccggtcccttcccccgtggcccgtcccgtgcctccgaggacgccacccgtccgaggacgcacgacggccgcccgtgggctcgccgtggtacaacggtccttaaccttcccacttacagtcgcttggngccgggctggcgaaggcgactaagngn

SEQ ID NO: 337873 - DNA, 624 bp, Homo sapiens
  misc_feature: GZ8MTXP01DW8CM.10.85.H08.1.454.CMB.2.raw
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
  modified_base (528)..(528): a, c, t, g, unknown or other
  misc_feature (528)..(528): n is a, c, g, or t
  modified_base (550)..(550): a, c, t, g, unknown or other
  misc_feature (550)..(550): n is a, c, g, or t
  modified_base (572)..(572): a, c, t, g, unknown or other
  misc_feature (572)..(572): n is a, c, g, or t
tcagcatagtagtgcacgaccggtgctcgatttagtatcactcagtcgcggggagagaggagccttagccctggactccaaggcctctccacttggtgatcagcactgagcacagaggactcacatggaattggggctgagcttgggttttccttgttgttatttagaaggtgtcaatgtgaggatcagcgtggtggagtcgtgggggagccgtggtccgaggccgggggtcctgagactctccgtgtggngcgtcgattcgacttgatatatgatgagcgtggtccncaggctcgaaggggaggggctgggagtgggtcggacccaacgaagtaaaaggaagagtgggaaagtggaagtaaacttacgtttggtacggggtcttcgttgggtagggaaacggggtccctaatttccgaaaccctagtcctaccgaagaacgaaccaacgaccaaaaggaaactcaacttgaactactgaacaaagttacggggaaacgagttggaagaagaacggtcgaaaggaacncggtcttagttaattgtttcgngttggacggaggggacgtccgngttagttggttaaccgaccgttgcgggaccacgggtaacccgttggtaaccc

SEQ ID NO: 337874 - DNA, 634 bp, Homo sapiens
  misc_feature: GZ8MTXP01A93TN.10.85.H08.1.454.CMB.2.raw
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
  modified_base (508)..(508): a, c, t, g, unknown or other
  misc_feature (508)..(508): n is a, c, g, or t
  modified_base (542)..(542): a, c, t, g, unknown or other
  misc_feature (542)..(542): n is a, c, g, or t
  modified_base (558)..(558): a, c, t, g, unknown or other
  misc_feature (558)..(558): n is a, c, g, or t
tcagcatagtagtgcacgaccggtgctcgatttagtatcactcagtcgcggggaggtctcagagaggagcctagccctggactccaaggcctctccacttggtgatcagcactgcgcacagaggactcaccatggaattggggctgagtcttgggttttccttgttgttatttagaagtgtcaatgtgaggagcagctggtggagtcgtgggggagccgtggtccgagggcccggggggtcctggacgactctccgtggtggagcggtccggattcgacttgatacttatggatgagcgtggccncaggctccgaggggagggctggagtgggtgccaacgaagtaaaggaagagtaggaaagtcgaaagtaacttaacgtttggngggcttcgtggtaggaaacggggtcccaagtttccacctaattccgacccgaaggaagaaaccaaaccggaccaaaaggactacaacttgtaatccgtagggaactaaaagttgaaaacgtntggtagaaggaaggtccgaaggggactacgggtnttaagttattgttcgnggtcggacggggaacggggcgttccggtaagttaggtcgggtcccgacggttcgggtaaccggggcccgtaacggg

SEQ ID NO: 337875 - DNA, 695 bp, Homo sapiens
  misc_feature: GZ8MTXP01DYHNP.10.85.H08.1.454.CMB.2.raw
  modified_base (433)..(433): a, c, t, g, unknown or other
  misc_feature (433)..(433): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagccgtggtccgaggccggggggtccctgagactctcctggtggagcgtcggtatcgacttgatacttatggatgagcgtgggtacccgccgaggcgtccgaagggggaagggcgtgggtaggtgggtcggaccaccgaagtaaaggagagtaggaaagtgagtaacttaacgtttggtgggctcgtgggtagaaacgggccgtattaccgaaccctnttccaccgagaacgaaccaaacgcccaaagacgtcactgtaactcgtaagaactaaagtagaacgtagtggtaggtaaggtaaaggtccgggaaaggtaccgtaacggtcgtttaaggtttaacgttttacgtttcggttagggtaacggggtaccggggggttaagggggttaccggttacccgggttaaggtttacggggtttcccggggttacccgggacccggttcggggttaaccgggggaaacccggtaacggggg

SEQ ID NO: 337876 - DNA, 649 bp, Homo sapiens
  misc_feature: GZ8MTXP01C3G2C.10.85.H08.1.454.CMB.2.raw
  modified_base (406)..(406): a, c, t, g, unknown or other
  misc_feature (406)..(406): n is a, c, g, or t
  modified_base (443)..(443): a, c, t, g, unknown or other
  misc_feature (443)..(443): n is a, c, g, or t
  modified_base (543)..(543): a, c, t, g, unknown or other
  misc_feature (543)..(543): n is a, c, g, or t
  modified_base (565)..(565): a, c, t, g, unknown or other
  misc_feature (565)..(565): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgacgggcccggggggtccctggacgactctcctggtggagcgtcggtattctactttgattacttagttggatgagcgtcgggtccgccgaggccgtccgagggggaacgggcgtgggaggttcgggtcggccaacgtaaagtaaaaggagagtaggaaggtagaagtaacttacgtttggngggtcttcgtggtagggaacgggccgtattccgaccnttccgaccagacgaaccaacgacaaagactcactgtaactcgtagaacgtaaagtccggaaaagtgtaggtggaagtacgtacgggaagtaccgacggtnttaggttaatttagtttgcggnggtaccgggaggggaccgttccggttacttaaggtcgggtcccgacggttcgggttcggggaacccgttaaccgggtaaccccg

SEQ ID NO: 337877 - DNA, 709 bp, Homo sapiens
  misc_feature: GZ8MTXP01A3RQ2.10.85.H08.1.454.CMB.2.raw
  modified_base (348)..(348): a, c, t, g, unknown or other
  misc_feature (348)..(348): n is a, c, g, or t
  modified_base (535)..(535): a, c, t, g, unknown or other
  misc_feature (535)..(535): n is a, c, g, or t
  modified_base (577)..(577): a, c, t, g, unknown or other
  misc_feature (577)..(577): n is a, c, g, or t
  modified_base (599)..(599): a, c, t, g, unknown or other
  misc_feature (599)..(599): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccataggaattggggctgagcttgggttttccttgttgttattttagaaggtgtccaatgtgaggagcagtcgtgggtggagttcggtggggggacgtccgtgggtcccgacggggtccccggggggggttccctggacgtccttccgtccgtggtgggacgcggttccggtattcggtactttgaattacttagttggatggacgtcgtcgggtcccnccgaggcctccggaagggggagggggtcgtgggaggtcggggtcgaccaacgaagtaaaaggagagtaggaagtgaagtaacttcgttggcgggctgtggtaggacgggcctattccactatccacaagacgacctaacgaccaaaggactcaacttgtactcgtacgaactaaaagttcggaaacngttggagaacggtagtaccgggaacggtaccgtaccgggttnttaggttaactttcgtttcggngggttcgggacgggggtaacgggggccgttccgggttacgttaacgggttccggggttccccggcggttccgggggttaccggggtaaccgttaacccgggggtaacccg

SEQ ID NO: 337878 - DNA, 700 bp, Homo sapiens
  misc_feature: GZ8MTXP01AFI0Q.10.85.H08.1.454.CMB.2.raw
  modified_base (403)..(403): a, c, t, g, unknown or other
  misc_feature (403)..(403): n is a, c, g, or t
  modified_base (578)..(578): a, c, t, g, unknown or other
  misc_feature (578)..(578): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggaggccgtggtccgaggcccggggggtccctgagactctccgtgtggagcgtccggattcgactttgatacttattggatgagcgtcgggtcccgccgaggcctccggaagggggagggggctgggaggtggggtcggaccaacgaagtaaaggaagagtagggaagtgaagtaacttacgtttgggngggtcttcgtgggttagggaaacggggtcccgtagtttaccaacctattcccacccggaaggaacgaacccaaaccggtacccaaaaggtaacgtccaacgttgtaaacttccgtaggaacctaaaagtggaaaccgtagtggtagaagaggttaccggaaggaccaacgggttnttaagttaacttagtttcgagggttcgggacggggtaacgggggcgttccgggttagtttaacgggttcgggttcccggaccggttcggggaccggggtaacccgttaaccggggtaacccg

SEQ ID NO: 337879 - DNA, 664 bp, Homo sapiens
  misc_feature: GZ8MTXP01AB79U.10.85.H08.1.454.CMB.2.raw
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagcatagtagtgcacgaccggtgctcgatttagtatcactcagtcgcgggctccacttggtgatcagcactgagcacagaggactcaccatggaattggggctgagctgggttttccttgttgttattttagaaggtgtccaatgtgaggagcagctggtggagtcgtgggggagcctggtccaggccggggggtccctgagactctccgtgtggagcgtccggattcgactttgatacttattggatgagctgggtccncaggctccgagggagggctggagtgggtgccacataaagganatggaatgagtaactcgtttgnggctntgtgaagggccattcacatcncaagagaacacgccaaagacgtcactgtatctagactaaaagtcgaaacgtagtaggtagaaggtacggtacggaagggaaccgaacgggtcgttagggttaatttacgttttccgaggttcgggaccgggaggggggaacgtccccggggtattaaggtccggggtttccgggaaccccgttcgggtaccggggggttccccaaacgggggttaacccccgttgggtaccccgttacccgggttcttaccgaacgttcccgaaccggccccgttaccccgaacccggtaaacgggggcccccttaaccggg

SEQ ID NO: 337880 - DNA, 621 bp, Homo sapiens
  misc_feature: GZ8MTXP01AYBH3.10.85.H08.1.454.CMB.2.raw
  modified_base (393)..(393): a, c, t, g, unknown or other
  misc_feature (393)..(393): n is a, c, g, or t
  modified_base (529)..(529): a, c, t, g, unknown or other
  misc_feature (529)..(529): n is a, c, g, or t
  modified_base (547)..(547): a, c, t, g, unknown or other
  misc_feature (547)..(547): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgaggtccggggggtccctgagactctctgtggagcgtcggattcgacttgatactatggatgagcgtggtccgcaggctaccggaggggaagggggcgtgggaggtggggtcggaccgaacgaagtaaaagggagagtagggaagtgaagtaaacttacgtttggnggggctcgtggtacggacgggtccgaattccaactatcgtacccaaaggacgaacaaacgaccaaaggaacgtccacgttgtaatctagaacaaagtgaaacgtatggtagaggacgtacggaaggtaccacggtnttaggtaattagtttcgnggttggacgggaggggacgcggcttaaggcggtttccggaccgttgggcggggtaaccgaacgggggtaacccc

SEQ ID NO: 337881 - DNA, 670 bp, Homo sapiens
  misc_feature: GZ8MTXP01B274S.10.85.H08.1.454.CMB.2.raw
  modified_base (540)..(540): a, c, t, g, unknown or other
  misc_feature (540)..(540): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtcaatgtgaggagcagctgggtggagtcgtgggggaggcctggtccgaggccggggggtccctgagactctcctgtggagcgtccggattcgactttgatacttattggatgagcgtgggtccgcaggctccgaggggaggggctgggagtgggtggccacgaagtaaaaggagagtaggaacgttagaagtaaaccgttagttttcgggtaggggccttcgttagggtacgggaaacggggtccccggtaaattttccgaaacccctattcctaccccgaaaggaccgaaaccgaaaccggaccccaaaaggaacgttccaacgttgtaattccgtagacctaaaatggaaaacgtgttagngaaggtagtaccggaagggaccacgggtcttggttaacttaagtttgtcggttggcggagggggacgccgggacttaagtcggggttccggtacccgtggttaccgggggccgttaacgggggtaacccg

SEQ ID NO: 337882 - DNA, 731 bp, Homo sapiens
  misc_feature: GZ8MTXP01A0KO5.10.85.H08.1.454.CMB.2.raw
  modified_base (606)..(606): a, c, t, g, unknown or other
  misc_feature (606)..(606): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttcttgttgttatttagaggtgtccaatgtgaggagcagcgtggtggagtcggtgggggaggccgtggtccgagggcccggggggtccctgacgactctccgtggtggagcgtccggattcgtactttgatacttagttggatggagtcgtcgggtcccgccgaggccgtaccggagggggaacgggggtcgtaggggaggtgggggtcggccaaccgaagtaaagggaagaggtagggaagtaggaagtaacgttacgtttgggtacgggtctcgttagggtacgggaacggggcccgtacttaccgtaaccctacgttcccgtaccgaaggaacgaaaccgaaaccgacccgaaaagtaacgtaccaacgttagtaactaccgttaggaactaaaagtcggaaacgtagttaggagaaggtacggtacggaacgggtccgaaccgggtnttaggtaactttacgttttggagggttcggacggggtaagggggacgttccgggacgttaagggttccggggtttccggacccgttcggggaccgggggtaaccgttaaaccgggggtaaccccg

SEQ ID NO: 337883 - DNA, 670 bp, Homo sapiens
  misc_feature: GZ8MTXP01BP7XP.10.85.H08.1.454.CMB.2.raw
  modified_base (610)..(610): a, c, t, g, unknown or other
  misc_feature (610)..(610): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttatttagaaggtgtccaatgtgaggagcagctgggtggagtcgtgggggacgccgtgggtccgaggggtcccgggggggtccctgacgtacctctccgtggtgggacgcggtccggattcgtactttgattacttagtggatgagcgtgggcccgcgaggccgtaccggagggggacggggcgtagggtaggtcggggtacgacccaacgaagtaaaaggagtagtagggaagtagaagtaacgttcgtttaagggcgggtctcgtggacgggaacggggtcctagttaccaacctactccgtaccagaacgaaccaaacgaccaaaggactccattgtatcgtagacgtaaagtacggaagtgttaggtacgaggtaaggtcccgggaaggaacccgtacggtcgttagttaattagtttcgtaggttggacgggtagggggccncggttcgtaagttcggggtaaccgccgtcgggttacggggaaccgttaacgggtaacccg

SEQ ID NO: 337884 - DNA, 576 bp, Homo sapiens
  misc_feature: GZ8MTXP02IXZK2.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccgccaggctccgaggggaaggggctggaggtgggtggccacgataaaggaagagtggaagtgagaacttactttggtggggcttcgtggtggaaggggccgattcaccatctccagagacaacgaccaagaagtcactgtatctagacaaatgaaacgatgagagagtcggaaggacacgggcttggtaattagttttcgtggtggacggagggggacgcccggtagttaagtcggggtttacggacccttggtcgggggaccaacgggggtaaccccg

SEQ ID NO: 337885 - DNA, 549 bp, Homo sapiens
  misc_feature: GZ8MTXP02GK4H6.10.85.H08.1.454.CMB.2.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (548)..(548): a, c, t, g, unknown or other
  misc_feature (548)..(548): n is a, c, g, or t
tcagcatagtagtgcacgaccggtgctcgatttagtatcactcagtcggggctgggaggcctggtccagccggggggtccctgagactctcctgtggagcgtccggattcgactttgatacttattggatgagctgggtccgccaggctccgagggaagggctggagtgggtggccaccaataaaggaagatggaagtgagaactactttgtgggctctgtgaagggccattcaccatctccagagacaacgccaagaagtcactgtatctgacaaaatgaaacgatgtgagagtcgaggacacggctgtatatttcngtgcgagggganccggntatggtcgactcgtggggccagggaccctggtcacgtctcatcagccctcaccgaagggcccatccggtccttcccccgtggcccgccctgcctccgaggacgccacctccgagagcacgacgccggcccgtgggctcgccgtggtacgaaacggacctaccttacccactacctatcgcgtgacgcgggcgtcggacgaacggcgcagtagng

SEQ ID NO: 337886 - DNA, 547 bp, Homo sapiens
  misc_feature: GZ8MTXP02FOARC.10.85.H08.1.454.CMB.2.raw
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
tcagcatagtagtgcacgaccggtgctcgatttagtatcactcagtcgggggctgggaggcctggtccagccgggggttccctgagactctcctgtggagcgtccggattcgactttgatacttattggatgagctgggtccgccaggctccagggaaggggctggagtgggtggccaccataaaggaagatggaagtgagaactactttgtggctctgtgaagggccgattcaccatctccagagacaacgccaagaagtcactgtatctgcaaatgaaacgatgtgagagtcgaggacacggctgtatatttctgtgcggaggggagccgggctatggttcggacctccgtgggggccaggggaacccctggtccaccgtctcatcagccctccaccaaaggggccccatccggtccttccccccgtggccgcccctgcctcccaggacgcaccctccgacgagcacaggcggccccgtgggcctgcctggtcaaggactaccttcccactacctatcgctgagcgggcgtggcacggcgcanan

SEQ ID NO: 337887 - DNA, 506 bp, Homo sapiens
  misc_feature: GZ8MTXP02FZDM8.10.85.H08.1.454.CMB.2.raw
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (500)..(506): a, c, t, g, unknown or other
  misc_feature (500)..(506): n is a, c, g, or t
tcagcatagtagtgcacgaccggtgctcgatttagtatcactcagtcggggggtccctgagactctcctgtggagcgtccggattcgactttgatacttattggatgagctgggtccgccaggctccagggaaggggctggagtgggtgccacataaaggagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctcgtggggccagggaaccctggtcaccgtcctcatcagcctccaccagggcccatcggtcctccccctgcnccctgcctccagancacctccgagagcacagcggccctggggcctggcctgggtacaaaggacctacttcccactactatcgctgacgcgggctcggcaaaggcgcatagnnnnnnn

SEQ ID NO: 337888 - DNA, 522 bp, Homo sapiens
  misc_feature: GZ8MTXP02HXQD0.10.85.H08.1.454.CMB.2.raw
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtcctgagactctctgtggagcgtccgattcgactttgatacttatggatgagctgggtccgcaggctccgagggagggctggagtgggtggccacataaaggaganggaagtgagaactactttggtggctntggtgaagggccattcacatctcagagacacgcaaagaagtcatgtatctagacaaatgaaacgtatgtagagagtcggaaggacacggctagtatatttcgngttgacggaggggacnccggntagtggtcgactcgcggggcacgggacccttggcc

SEQ ID NO: 337889 - DNA, 540 bp, Homo sapiens
  misc_feature: GZ8MTXP02HB14K.10.85.H08.1.454.CMB.2.raw
  modified_base (261)..(261): a, c, t, g, unknown or other
  misc_feature (261)..(261): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
tcagcatagtagtgcacgaccggtgctcgatttagtatcactcagtcgcgggctccacttggtgatcagcactgagcacagaggactcaccatggaattggggctgagctgggttttccttgttgttatttagaggtgtccaatgtgaggagcagctggtggagtcgtgggggaggcctggtccaggccgggggggtccctgagactctcctgtggagcgtccggattcgactttgatacttattggatgagctgggtccncaggctccgagggaagggctggagtgggtggccacataaaggagatggaagtgagaactactttggtgggctcgtgtggaagggccgattcaccatctcagagacaacgcaaagagtcactgtatctgacaaatgaaacatgtgagagtcgaggacacggctagtattatttcgnggtgcggaggggganccgggntagtgggttcgaccttcggtcggggccacggggaccctggtccaccgtctacaatcacgccctaccaccgaacgggcccctag

SEQ ID NO: 337890 - DNA, 530 bp, Homo sapiens
  misc_feature: GZ8MTXP02HZ4IS.10.85.H08.1.454.CMB.2.raw
  modified_base (367)..(367): a, c, t, g, unknown or other
  misc_feature (367)..(367): n is a, c, g, or t
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
tcagcatagtagtgcacgaccggtgctcgatttagtatcactcagtcgcgggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccggggggtccctgagactctcctgtggagcgtccggattcgacttgatacttattggatgagctgggtccgccaggctccgagggaaggggctgggagtggggtggccaccataaaaggagatggaagtgagaactactttgngggctctgtgaagggccattcaccatctccagagacaacgccaagaagtcactgtatctgcaaatgaaacgatgtgagagtcgagacgacggctgtatatttcngtgcgagggggacnccggntaagtcgggttacgacctcgtggggcccgagggtaacccg

SEQ ID NO: 337891 - DNA, 604 bp, Homo sapiens
  misc_feature: GZ8MTXP02JQKLB.10.85.H08.1.454.CMB.2.raw
  modified_base (472)..(472): a, c, t, g, unknown or other
  misc_feature (472)..(472): n is a, c, g, or t
  modified_base (524)..(524): a, c, t, g, unknown or other
  misc_feature (524)..(524): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccaggccggggggtccctgagactctcctgtggagcgtccggattcgacttgatacttattggatgagcgtgggtccgccaggctccgaggggaaggggcgtgggaggtgggtggccacaagtaaaggagagtgggaagtgaagaacttacgtttggtgggctcgtggtggaaacggggccgtaagtttccaaccattccctacccgaaggaacgaacaaaccgcccaaaaggaacgtcaactgtatcgngacaaaagtgaaacgtatgtagagagtcgagaccaggctagtattatttcgnggtgacgggtagggggactcccgggattaaggttcgggttaccggaccttcgggtacgggggcccaagggggtaaccccc

SEQ ID NO: 337892 - DNA, 567 bp, Homo sapiens
  misc_feature: GZ8MTXP02HGB6A.10.85.H08.1.454.CMB.2.raw
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccgccaggctccgaggggaaggggctggagtggggtggccaccgataaaggagagtggaagtgagaactagtttgnggggctcgtgtgaagggccgattcacatctccaganacaacgccaagaacgtcactgtatctagacaaatgaaacgatgtgaagagtcggaaggacacggctagtactatttcgtggtggacggagggggacgcccgggtcgtaaggttcggggtttaccggaccgttcggtcgggggacccaaacggggg

SEQ ID NO: 337893 - DNA, 556 bp, Homo sapiens
  misc_feature: GZ8MTXP02GNKN3.10.85.H08.1.454.CMB.2.raw
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttcctgttgttattttagaaggtgtccaatgtgaggagcagctggtggagtcgtgggggaggcctggtccaggccggggggtccctgagactctcctgtggagcgtccggattcgactttgatacttattggatgagctgggtccnccaggctccgagggaggggctggagtgggtggccacgataaaggaagatggaagtgagaactacttgnggctcgtgtgaagggccgattcaccanctcagagacaacgccaaagagtcactgtatctgacaaatgaacgatgtagagagtcgaggacacggctagtattatttcgtggtgcggaggggacgcccggggtactaggtcgggttcgggacccttcggtcgggggcccaacgggggtaaccccttgggtacccg

SEQ ID NO: 337894 - DNA, 557 bp, Homo sapiens
  misc_feature: GZ8MTXP02I0YP6.10.85.H08.1.454.CMB.2.raw
  modified_base (369)..(369): a, c, t, g, unknown or other
  misc_feature (369)..(369): n is a, c, g, or t
  modified_base (470)..(470): a, c, t, g, unknown or other
  misc_feature (470)..(470): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccaggccggggggtccctgagactctctgtggagcgtccggattcgactttgatacttattggatgagctgggtccgccaggctccgaggggagggctgggagtgggtggccacgagtaaaggaagatggaagtgagaactactttggngggctcgtgtgaagggccgattcaccatctccagagacaacgccaagagtcactgatctgacaaatgaaacgatgtgaggagtcggaaggacaaccgggtnttagttattatttgtggtacggcgggacggggacgccggtatcggttcggggtaccgccgtcggcggggacccgtaacgggtacccg

SEQ ID NO: 337895 - DNA, 558 bp, Homo sapiens
  misc_feature: GZ8MTXP02HIPFD.10.85.H08.1.454.CMB.2.raw
  modified_base (486)..(486): a, c, t, g, unknown or other
  misc_feature (486)..(486): n is a, c, g, or t
  modified_base (511)..(511): a, c, t, g, unknown or other
  misc_feature (511)..(511): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagtccggggggtccctgagactctcctgtggagcgtccggattcgactttgatacttattggatgagctgggtccgccaggctccgaggggaaggggctggagtgggtggccacagtaaaggaagataggaagtgagaacttacgtttggtgggctcgtggtaggaagggccgtattcaccatctaccagagacaacgccaaagagtcactgatctgacaaatgaacgatgagagagtcgagacaggctggtattatttcnggtgacggtagggggacgcccgggnttaaggtggttaccggacctcggtcgggggccaacggggtaaccccg

SEQ ID NO: 337896 - DNA, 569 bp, Homo sapiens
  misc_feature: GZ8MTXP02GTVNV.10.85.H08.1.454.CMB.2.raw
  modified_base (371)..(371): a, c, t, g, unknown or other
  misc_feature (371)..(371): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttatggatgagctgggtccgccaggctccgaggggaaggggctgggaggtgggtggccaccagtaaaggagatggaagtgagaactacttggngggctcgtgtggaagggccgattccacctatctccagacgacaacgccaaagagtcactgtatctgacaaatgaacgatgtgagagtcgaaggacacggggtctaggttacttagtttcgtggtggcgggtaggggacgcccggtagttaagtcgggttccgggaccttcggtcgggggccgaacggggtaacccccg

SEQ ID NO: 337897 - DNA, 650 bp, Homo sapiens
  misc_feature: GZ8MTXP02IHLAH.10.85.H08.1.454.CMB.2.raw
  modified_base (289)..(289): a, c, t, g, unknown or other
  misc_feature (289)..(289): n is a, c, g, or t
  modified_base (359)..(359): a, c, t, g, unknown or other
  misc_feature (359)..(359): n is a, c, g, or t
  modified_base (511)..(511): a, c, t, g, unknown or other
  misc_feature (511)..(511): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattgggctgagctgggttttcctgttgttatttagaaggtgtccaatgtgaggagcagctggtggagtcgtgggggagcctggtccgaggccggggggtcctgagctctctgtggagcgtccggattcgactttgatacttatggatgagctgggtccncaggctcgagggaggctggagtgggtgccacaataaaggaagagtaggaagtgaagtaacttactttggngggcttcgtgggtacggaaagggggtccctaatttcccgaacctagttccctacccgaaagacgaaaccaaaccgacccaaaaggaaacgtccaacttgtatctgaactaaaagtgaaacgtattgagaagaggtacgacggacgaacggtnttagtaatttacgtttcgtagggtcgggacggggtaacgggggaccgtccgggtacgtttaggttccgggggttaacccggtaacccgttcggggtaccgggggaacccgtaaacccgggggtacccgtcgggtacccg

SEQ ID NO: 337898 - DNA, 677 bp, Homo sapiens
  misc_feature: GZ8MTXP02GOT4L.10.85.H08.1.454.CMB.2.raw
  modified_base (560)..(560): a, c, t, g, unknown or other
  misc_feature (560)..(560): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggccggggggtcctgagactctcctgtggagcgtccggattcgactttgatacttatggatgagcgtgggtcccgccaggctaccgaggggaaggggctggggaggtggggtcggaccaccgaaagtaaaagggaagagtgggaaagtgaagaacttacgtttggagggtctcgtggtaggaaggggcccgtatttccgacctatccctaccaagacgaaccaaacgacccaaaaggaacgtaccaacgttagtacttaccgtacggaaacctaaaaagttcggaaaaccggtattagggtagaagggtacggtacggaaggaccgaaccgggttnttagttaactttacgtttcgtgggtacgggacggggacggggaccgcccgggtagttaagggttccgggttaccggaccggttcggggtaccgggggacccggtaacggggtacccg

SEQ ID NO: 337899 - DNA, 780 bp, Homo sapiens
  misc_feature: GZ8MTXP02HQVJX.10.85.H08.1.454.CMB.2.raw
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctgggtggagtcgtgggggaggcctgggtccgaggccgggggggtccctggagactctcctgtggagcgtccggattcgactttgatacttattggatgagctgggtccncaggctcgagggagggctggagtgggnggccacagtaaaaggagatggaagtgaagtaacttacttttgggtggggcttcgtgggttagggaaacgggggtcccgtaatttcccgaaccctaagtttccctacccgaaaggaacggaaaccctaaaaccggaccccgaaaaagggtaaaacggttccccaaactttagggttaaacttccgttaggaaacctaaaaagttggaaaaaccggtagtttaggtacgggaaaggaacggttaccgggaaaagggggaacccaacgggggtcctttaaggttaaatttagtttttccgtggggttagggaccggggttaagggggggaaacgcccccggggtacgtttaaaggtttcgggggttttccccggggaacccgtttcgggggttaccgggggggacccccttaaaaccggggggaaacccccgtttttcgggggtaaaccccccgg

SEQ ID NO: 337900 - DNA, 616 bp, Homo sapiens
  misc_feature: GZ8MTXP02FXBFF.10.85.H08.1.454.CMB.2.raw
  modified_base (261)..(261): a, c, t, g, unknown or other
  misc_feature (261)..(261): n is a, c, g, or t
  modified_base (474)..(474): a, c, t, g, unknown or other
  misc_feature (474)..(474): n is a, c, g, or t
tcagcatagtagtgcacgaccggtgctcgatttagtatcactcagtcgcgggctccacttggtgatcagcactgagcacagaggactcaccatggaattggggctgagctgggttttccttgttgttatttagaggtgtccaatgtgaggagcagctggtggagtcgtgggggaggcctggtccaggccgggggggtccctgagactctcctgtggagcgtccggattcgactttgatacttattggatgagctgggtccncaggctccgagggagggctggagtgggtgccacgataaaggagatggaagtgagtaacttacgtttggtgggcttcgtggtaggaaacggggccgtaatttccgacctatcctacccgaaggaacgaccaaaccgccaaaaggaacgtcaacttgtaactctgacaaaatgaaacgatggtagagagtcgaaggacacggctgtatatttcgnggtgcggagggggacgccgggtattagtcgggttaccggaccgttcggtcgggggacccaacgggggtaaacccctgggtacccgacccggttctaccgaagttccgacggtcccctacccgaaccgaaccgggccctacgg

SEQ ID NO: 337901 - DNA, 681 bp, Homo sapiens
  misc_feature: GZ8MTXP02IUZ32.10.85.H08.1.454.CMB.2.raw
  modified_base (295)..(295): a, c, t, g, unknown or other
  misc_feature (295)..(295): n is a, c, g, or t
  modified_base (541)..(541): a, c, t, g, unknown or other
  misc_feature (541)..(541): n is a, c, g, or t
tcagcatagtagtgcacgaccggtgctcgatttagtatcactcagtcgcggggagagaggaggccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccggggggtcctgagactctcctgtggagcgtccggattcgactttgatacttattggatgagctgggtccnccaggctccgagggaggctggagtgggtcgcccacgagtaaaggagagtggaagtgagaacttacgtttggtagggccttcgtgggtaggaaacggggtccgtattccgaacctattcctaccgaaagacgaaccgaaacgaccgaaaaggtaagttccaaacgttgtaactaccgtaggaacctaaaagttggaaaaccgtagttacgggtagaacggtagttacggaaaggacgtaaccgggtnttaggtactttaagtttcgagggttacggaccggtaaagggggctacccggggtacgttaacggttcggggttaacccggaacccgttcgggttacgggggacccctaacggggggtaaccccctttggggtaacccccg

SEQ ID NO: 337902 - DNA, 733 bp, Homo sapiens
  misc_feature: GZ8MTXP02IIE25.10.85.H08.1.454.CMB.2.raw
  modified_base (543)..(543): a, c, t, g, unknown or other
  misc_feature (543)..(543): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgagggcccggggggtccctggagactctcctgtggagcgtccggattcgactttgatacttagttggatgagcgtcgggtccgccgaggcctccggaggggaaggggcgtgggaggtggggtcggacccgaaaccgaagtaaaagggaaagagtagggaagtaggaagtaaacgttacgttttggtggggcttcgtgggtaggaaacggggccctaagtttcccaacacgttcccacccgaagaacgaaacccaaacggacccaaaaggtaaacgtcaaccgttagttaactccgtagaaacctaaaagttacggaaaaagtnttagggtaggaagtaggtacggaaggaaccgacggggtacttaggttaaattacgtttttcgtagggttcgggaccgggaaaggggggtccgtccccggggtacttaagggttacggggttcccgggtaaccgttccggggtaccgggggaccccgaaccgggggtaacccccgtttggggtaacccccg

SEQ ID NO: 337903 - DNA, 577 bp, Homo sapiens
  misc_feature: GZ8MTXP02F3YS1.10.85.H08.1.454.CMB.2.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccnccaggctccgagggagggctggagtgggtgccacagtaaaggagagtggaagtgagaactacgtttgnggggctgtgtgaagggccattcaccatcncaganacaacgccaaagaagtcactgtatctgacaaatgaaacgatggtagagagtcggaggacgacgggctaggtattagtttcgtaggtcgacgggtaagggggacgtcccgggtaagttaacggtcggggtttaccggacccgtttcgggtacgggggacccgtaaaccggggg

SEQ ID NO: 337904 - DNA, 580 bp, Homo sapiens
  misc_feature: GZ8MTXP02HV4YM.10.85.H08.1.454.CMB.2.raw
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
  modified_base (579)..(579): a, c, t, g, unknown or other
  misc_feature (579)..(579): n is a, c, g, or t
tcagcatagtagtgcacgaccggtgctcgatttagtatcactcagtcgggggctgggaggcctggtccagccgggggggtccctgagactctcctgtggagcgtccggattcgacttttgatacttattggatgagctgggtccgccaggctccagggaagggctggagtgggtggccaccataaaggaagatggaagtgagaactactttgtgggctctgtgaagggccattcaccatctcagagacaacgccaagagtcactgtatctgacaaatgaacgatgtgagagtcgaggacacggntgtatatttcngtgcggaggggagccggctagtggtcgacctcgtggggccaggacctgtccncgtctcatcacgcctacacacggcccatcgtcctccccgtgccgccctcgctccgagacgccaccgtccgagacgcaccgacggccggcccgtcgggcctcggtcccgtaggtaccgaaaacgggtacccttaaccgttcccctaattaaccgttacgttcgaccgttcggacggccggggcgttcgggacgaaacgggcgacgtatacggng

SEQ ID NO: 337905 - DNA, 595 bp, Homo sapiens
  misc_feature: GZ8MTXP02H3YFB.10.85.H08.1.454.CMB.2.raw
  modified_base (508)..(508): a, c, t, g, unknown or other
  misc_feature (508)..(508): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtcaatgtgaggagcagctggtggagtcgtgggggaggccgtggtccgaggcccggggggtccctgacgactctcctgtggagcgtccggattcgactttgatacttatggatgagcgtgggtccgccaggctccgaggggaagggcgtggaggtgggtgccaaaccgagtaaaaggaagagtaggaagtgaagtaacttacgtttgtggggctcgtggtagaacgggccgattccgaccagtcctaccgaagacgaacaacgaccaaagaacgtacacgtgtatctgaacaaagtagaaacgtatgtagagagtacgaggacgacgnttagtattatttcgtggtagtacggacggggtacgccggtaagtagttcgggtaccggtaccgttcggtcggggacccgtaacgggg

SEQ ID NO: 337906 - DNA, 562 bp, Homo sapiens
  misc_feature: GZ8MTXP02GDHHQ.10.85.H08.1.454.CMB.2.raw
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
  modified_base (478)..(478): a, c, t, g, unknown or other
  misc_feature (478)..(478): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccgcaggctccgagggagtgctggagtgggtgccacataaaggagatggaagtgagaactactttgngggctcgtagtaaagggcctattcaccatcnccagagacaacgccaagagtcactgtatctagacaaatgaacgatgtagagagtcgaaggacacggctagtattatttcgnggtgacggagggggacgccgggtacttaaggttcgggtttaccggaccgttcggtacgggggacccgtaacgggggtaaccccg

SEQ ID NO: 337907 - DNA, 542 bp, Homo sapiens
  misc_feature: GZ8MTXP02JH6SQ.10.85.H08.1.454.CMB.2.raw
  modified_base (294)..(294): a, c, t, g, unknown or other
  misc_feature (294)..(294): n is a, c, g, or t
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttatttagaaggtgtccaatgtgaggagcagctggtggagtctgggggaggcctggtccaggccggggggtccctgagactctcctgtggagcgtccggattcgactttgatacttattggatgagctgggtccncaggctccgagggagggctggagtgggtggccacataaaggagatggagtgagaactactttgtggctcgtgtgaaggggccgattccaccatctccaganacaacgccaaagaagtcactgtatctgacaaatgaacgatgtagagagtgaggacacggntgtatatttcgtgtggcggtaggggacgccggctaagtcggttcggaccttcgtacgggggccaacggggtaacccctgggtacccg

SEQ ID NO: 337908 - DNA, 527 bp, Homo sapiens
  misc_feature: GZ8MTXP02IYYIA.10.85.H08.1.454.CMB.2.raw
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (443)..(443): a, c, t, g, unknown or other
  misc_feature (443)..(443): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtctgggggagcctggtccaggccggggggtccctggagactctcctgtggagcgtccggattcgactttgatacttattggatgagctgggtccncaggctccgagggagggctggagtgggtgccacataaagganatggaatgagaactacgtttgnggggctcgtgtgaaggggccattcacatctcagagacaaacgccaaagaagtccatgtatctagacaaaatgaacgangtagagacgtgaggacacggtctagtattattcgtagcgcgacgggacggcgcgtcgtacggtcggtacgtcgtcggacgacgg

SEQ ID NO: 337909 - DNA, 539 bp, Homo sapiens
  misc_feature: GZ8MTXP02J01F2.10.85.H08.1.454.CMB.2.raw
  modified_base (364)..(364): a, c, t, g, unknown or other
  misc_feature (364)..(364): n is a, c, g, or t
  modified_base (468)..(468): a, c, t, g, unknown or other
  misc_feature (468)..(468): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccgggggggtccctgagactctcctgtggagcgtccggattcgactttgatacttatggatgagctggtccgccaggctccgagggaggggctggagtgggtgccacataaaggagatggaagtgagaactactttgngggctctgtgaagggccgattcacatctccagagacacgccaagagtcactgtatctgacaaatgaacgatgtagagagtcgaggacacggctagtatatttcnggtgcggaggggacgcccgggtataaggtcgggttccggaccttcggtcgggggccgaacggggtaccccg

SEQ ID NO: 337910 - DNA, 769 bp, Homo sapiens
  misc_feature: GZ8MTXP02I2FKV.10.85.H08.1.454.CMB.2.raw
  modified_base (254)..(254): a, c, t, g, unknown or other
  misc_feature (254)..(254): n is a, c, g, or t
  modified_base (666)..(666): a, c, t, g, unknown or other
  misc_feature (666)..(666): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccgggggtaccgtcgagacgtctcctcgtggnggcgtccggtacgtcgtcgttgtagtacttattgtagtgtagacgtcgggtccggcccgacggcgtccgtacggggaagggggacggtcggtagggtaggggttcggggacccgacccgtaaacgtaaaagggaaaacgggtaagtaaggggtaaaggtaaggtaaggaaacgttaaaccgttttaggttggggtaccgttccttgggttagggtaaacgggggtacccggtacgttaccgttaacccgaacttccttacccgaaagaaggaacccaaaccgacccgaaaagtaaaaggtcccaacttacggtaataccttcgaaacgaaaataggaaaccggtaattgggtggaaaggaaggttcccgggaaggaaccgtaacgcggttagttagttaacttttcgttggngggaccggaggggggaacgtcccgggtaccgtttaagttcggggttccggtaacccgtcggtcgggggacccggtaaccgggtaaccccggtacggttcccgg

SEQ ID NO: 337911 - DNA, 583 bp, Homo sapiens
  misc_feature: GZ8MTXP02IAAN0.10.85.H08.1.454.CMB.2.raw
  modified_base (484)..(484): a, c, t, g, unknown or other
  misc_feature (484)..(484): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccgccaggctccgaggggagggctggagtgggtgccacataaaggaagatggaagtgaagaacttacgtttggtggggcttcgtggtaggaaaggggcccgtatttccaccatcctacccagacgaccaacgccaaagaagtcactgtatctagacaaatgaaacgtatggagagagtcgaggacacggtntagtattattcgtggtggacgggaggggacgccggtacttaggtcgggttccggaccgttcgggtcgggggacccgacggggtaccccttcgggtaccc

SEQ ID NO: 337912 - DNA, 551 bp, Homo sapiens
  misc_feature: GZ8MTXP02J042S.10.85.H08.1.454.CMB.2.raw
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (550)..(550): a, c, t, g, unknown or other
  misc_feature (550)..(550): n is a, c, g, or t
tcagcatagtagtgcacgaccggtgctcgatttagtatcactcagtcgggggctgggaggcctggtccagccggggggtccctgagactctcctgtggagcgtccggattcgactttgatacttattggatgagctgggtccgccaggctccagggaagggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttcngtgcgaggggnccggntatggtcgactcgtggggccagggaccctggcacgtctcatcagcctccaaccgaagggcccagtccggtccttcccccgtggcccgccctgcctcccgagacgccaccgtcccgagcgcacgacgccggccctggggctcggcgttgggtacaaggacccttaccttcccactactactcgccgtgacggccgggcgtcggacgacggcgcacgtagng

SEQ ID NO: 337913 - DNA, 579 bp, Homo sapiens
  misc_feature: GZ8MTXP02FX63A.10.85.H08.1.454.CMB.2.raw
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtccctgagactctcctgtggagcgtccggattcgactttgatacttattggatgagctgggtccncaggctccgaggggagggctggagtgggnggccacagtaaaggagatggaagtgagactagtttgngggctntgtgaagggcgattcacatctccagagacaacgccaaagaagtcactgtatctagacaaatgaaacgatgtagagagtcgaggacacgggtctagtattactttcgtaggtgcggaagggggcgcccgggtacgttagttcggggttaaccgggacccgttcgggttacggggggaccctaacgggggtaacccccgttggggtaccccg

SEQ ID NO: 337914 - DNA, 566 bp, Homo sapiens
  misc_feature: GZ8MTXP02GF8V8.10.85.H08.1.454.CMB.2.raw
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatactattggatgagctgggtccgcaggctccgagggaagggctggagtgggtgccacagtaaaggaagagtggaagtgagaactacgtttgngggctcngtgaagggccgattcaccatctccagacacaaacgccaagaagtcatgtatctagacaaagtgaaacgtatgtagagagtcgaaggacacggctagtaattagtttctggtggacggagggggacgcccgggtattaaggtcggggttaccggacccgttcggtacgggggaccctaagggggtaacccccg

SEQ ID NO: 337915 - DNA, 532 bp, Homo sapiens
  misc_feature: GZ8MTXP02IUXFE.10.85.H08.1.454.CMB.2.raw
  modified_base (324)..(324): a, c, t, g, unknown or other
  misc_feature (324)..(324): n is a, c, g, or t
  modified_base (441)..(441): a, c, t, g, unknown or other
  misc_feature (441)..(441): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (493)..(493): a, c, t, g, unknown or other
  misc_feature (493)..(493): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggcctggtccaggccggggggtccctgagactctcctgtggagcgtccggattcgacttgatacttattgatgagatgggtccgccaggctccgaggggaagggctggngtgggtgccaccagtaaaggaagagtggaagtgagaactactttgtgggctctggtgaagggccgattcaccatctccagagacaacgcaagagtcatgtatcagacaaatgaacgntagtgagagtcgaaggacagctagtatntttcgngtgcggaggggcgccggntaagtcgggtcgacctggtcggggaccacggggtacccg

SEQ ID NO: 337916 - DNA, 618 bp, Homo sapiens
  misc_feature: GZ8MTXP02IE0RT.10.85.H08.1.454.CMB.2.raw
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
tcagcatagtagtgcacgaccggtgctcgatttagtatcactcagtcgcggggagagaggagccttagccctggactccaaggtctctccacttggtgatcagcactgagcacagaggactcaccatggaattggggctgagctgggttttccttgttgttattttagaaggtgtccaatgtgaggagcagctggtggagtcgtgggggagcctggtccgaggccggggggtcctgagactctcctgtggagcgtccggattcgactttgatacttatggatgagctgggtccnccgaggctcgagggaggctggngtgggngccacgagtaaaggagagtggaagtgaagaaacttcgttaggtgggcttcgtggtggaaagggccgtattccgaccatccncaganaacacaccaaagacgtcaactgaatcagacaaaagtcgaaacgtagtgtaggaataaggtcgaaagggaccacgggacttaggtaattacgtttcgtgggttggacggtaaagggggcgtacccggggactttaagttcggggtttaaccgggaacccttcgggttccggggggaaccctaacggggggtaaccccctttggggaccccg

SEQ ID NO: 337917 - DNA, 581 bp, Homo sapiens
  misc_feature: GZ8MTXP02JYWY7.10.85.H08.1.454.CMB.2.raw
  modified_base (332)..(332): a, c, t, g, unknown or other
  misc_feature (332)..(332): n is a, c, g, or t
  modified_base (448)..(448): a, c, t, g, unknown or other
  misc_feature (448)..(448): n is a, c, g, or t
tcagcatagtagtgcacgaccggtgctcgatttagtatcactcagtcgcgggctccacttggtgatcagcactgagcacagaggactcaccatggaattggggctgagctgggttttccttgttgttattttagaaggtgtccaatgtgaggagcagctggtggagtcgtgggggaggcctggtccaggcccgggggggtccctgagactctcctgtggagcgtccggattcgactttgatacttattggatgagctgggtccgccaggctccgaggggaagggctggagtgggtgccacataaaggagatggaagtgagaactacgtttgngggctcgtgtggaaaggggccgattccaccatcctccagagacaacgccaaagagtcactgtatctgacaaatgaacgatgtgaaggagtcgaggacacgggcttgtattatttcnggtgcggagggggacgccgggctagtcggggttcgaccgttcggtcgggggccacgggggaaaccctcgggtaccacccggttctaccgaagttccgaacggtccctacccgacccgaacggggcccctacgg

SEQ ID NO: 337918 - DNA, 507 bp, Homo sapiens
  misc_feature: GZ8MTXP02JEIB4.10.85.H08.1.454.CMB.2.raw
  modified_base (392)..(392): a, c, t, g, unknown or other
  misc_feature (392)..(392): n is a, c, g, or t
  modified_base (499)..(507): a, c, t, g, unknown or other
  misc_feature (499)..(507): n is a, c, g, or t
tcagcatagtagtgcacgaccggtgctcgatttagtatcactcagtcggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccattcaccatctccagagacaacgccaaagaagtcactgtatctgcaaatgaacgatgtgagagtcgaggacacgggctgtatatttctgtgcgaggggagccggctatggttcggacctctggggccagggaccctggtcaccgtctcatcagcctccaccagggcccatcggtcttccccctggccnccctgctccaggagcaccctccgagacgcacagcggccctgggctgcctggtcaaggctacttcccactctatgctgacgcggggctcgggcaaacggcgacatagnnnnnnnnn

SEQ ID NO: 337919 - DNA, 565 bp, Homo sapiens
  misc_feature: GZ8MTXP02HXFHS.10.85.H08.1.454.CMB.2.raw
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (528)..(528): a, c, t, g, unknown or other
  misc_feature (528)..(528): n is a, c, g, or t
tcagcatagtagtgcacgaccggtgctcgatttagtatcactcagtcgcgggctccacttggtgatcagcactgagcacagaggactcaccatggaattggggctgagctgggtttcttgttgttattttagaaggtgtccaatgtgaggagcagctggtggagtcgtgggggagcctggtccaggccggggggtcctgagactctcctgtggagcgtccggattcgactttgatacttattggatgagctgggtccgccaggctccgaggggaaggggctggaggtggggtcggaccaccaataaaggaagagtggaaagtgaagaacttactttggagggtctcgtggtggaaagggccgattcaccatctccaganacaacgccaaagaagtcactgtatctgacaaaatgaaacgntagtagaagagtacgaggacacggtctaggtattatttcgnggtggaggagggcgcgtntagtcggtccgacctcggtcgggacgaacgggaccctcgtaccaccgtnacgtaacgtcgacgtcctaccgaccggacggtcccag

SEQ ID NO: 337920 - DNA, 643 bp, Homo sapiens
  misc_feature: GZ8MTXP02HJFVX.10.85.H08.1.454.CMB.2.raw
  modified_base (483)..(483): a, c, t, g, unknown or other
  misc_feature (483)..(483): n is a, c, g, or t
  modified_base (535)..(535): a, c, t, g, unknown or other
  misc_feature (535)..(535): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccagggcccggggggtccctgagactctcctgtggagcgtccggattcgactttgatacttattggatgagcgtgggtccgccgaggcctccgaggggaaggggcgtgggaggtggggtcggcccaaccgaagtaaaagggaaagagtagggaagtgaagtaacttacgtttggtgggcttcgtggtggaaacggggccgtattccaccatccgacaagacgaacaacgccaaagatcactgtatctagacaaaatgaaacgtntggtagaagacgtacggaaggaccacgggtcttaggttaattacgttttcgngggtagggacgggaagggggtaccgcccgggtacgttaggttccggggttaaccggacccgttcggggtaccgggggacccgtaaccgggggtaccccgttgggaccc

SEQ ID NO: 337921 - DNA, 540 bp, Homo sapiens
  misc_feature: GZ8MTXP02FZV6Y.10.85.H08.1.454.CMB.2.raw
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccnccaggctccgaggggagggctggagtgggtggccacgataaaggagatggaagtgagtaactactttggngggctctgtgaagggccgattcaccatcctcagagaacaacgccaaagaagtcactgtatctgacaaatgaaacgntgtagagagtcgaggacacggctaggtatatttcaggttcgcggaaggggnccggntagtcggttcggacctcgtcgggggcctaacgggg

SEQ ID NO: 337922 - DNA, 611 bp, Homo sapiens
  misc_feature: GZ8MTXP02GI40S.10.85.H08.1.454.CMB.2.raw
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtccctggagactctcctgtggagcgtccggattcgactttgatacttattggatgagctgggtccgccgaggcctccgagggaaggggctggagtgggtggcccacgagtaaaggaagagtggaagtgaagtaactacgtttggtgggcttcgtgggtgaaaggggccgtaattccgaacctatcctacccagacgaacaacgacccaaagaaacgtcaactgtatctagacaaaatgaacgatgtagagaaggtcgaaggtacaacgggtntagtattagtttcgnggtaggacgggtaggggacgccggtacgttacggttcgggtccggtaccggtcggtacgggggaccgtaacggggtaccccgttggtacccg

SEQ ID NO: 337923 - DNA, 593 bp, Homo sapiens
  misc_feature: GZ8MTXP02JKL1R.10.85.H08.1.454.CMB.2.raw
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (592)..(592): a, c, t, g, unknown or other
  misc_feature (592)..(592): n is a, c, g, or t
tcagcatagtagtgcacgaccggtgctcgatttagtatcactcagtcggggctgggaggcctggtccagccggggggtccctgagactctcctgtggagcgtccggattcgactttgatacttattggatgagctgggtccgccaggctccgagggaaggggctggagtgggtggccaccataaaggaagatggaagtgagaactactttgtgggctctgtgaagggccattcaccatctccagagataacgcaagaagtcactgtatctgacaaatgaaacgatgtgagagtcgaggacacggctgtatatttcngtgcggaggggcnccggntagtggttcggacctcgtggggccagggaccctggtccaccgtctcatcacgccctaccaccgaacgggcccagtcccggtcccttcccccgtggcccgtccctcgcctccgagggcgaccacccgtccgacgacgccacgacgggcccggcccgtgggcctcggccgtcgggtaccaaacggtacccttaccttaccccacttacctagtcgccgtacggacggtcggggcgtcgggaccgaacgggcacagtacgng

SEQ ID NO: 337924 - DNA, 649 bp, Homo sapiens
  misc_feature: GZ8MTXP02JLX8H.10.85.H08.1.454.CMB.2.raw
  modified_base (331)..(331): a, c, t, g, unknown or other
  misc_feature (331)..(331): n is a, c, g, or t
  modified_base (540)..(540): a, c, t, g, unknown or other
  misc_feature (540)..(540): n is a, c, g, or t
  modified_base (558)..(558): a, c, t, g, unknown or other
  misc_feature (558)..(558): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccagggccggggggtccctgagactctcctgtggagcgtccggattcgacttgatacttattggatgagcgtgggtccgccaggctccgaggggaaggggctggaggtggggnggcccaacgaagtaaagggaagagtagggaagtcggagtaaacttacgtttggtggggtcttcgtggtagggaaacggggtccgtaatttccgaacctatcctaccgaaggacgaaccaaaccggaccaaaagtaagtccaaacttgttaatcctagaactaaaagtggaaacgtgtaggtaggagtacggtacggaaggacgacgggnttagtagttattttcggnggtaggcgggaggggtacgccgggtacgttaggttcgggttaaccggccgttcggggtacggggaccggtaccgggtacccgttcggaccg

SEQ ID NO: 337925 - DNA, 542 bp, Homo sapiens
  misc_feature: GZ8MTXP02F76MD.10.85.H08.1.454.CMB.2.raw
  modified_base (328)..(328): a, c, t, g, unknown or other
  misc_feature (328)..(328): n is a, c, g, or t
  modified_base (465)..(465): a, c, t, g, unknown or other
  misc_feature (465)..(465): n is a, c, g, or t
tcagcatagtagtgcacgaccggtgctcgatttagtatcactcagtcgcgggctccacttggtgatcagcactgagcacagaggactcaccatggaattggggctgagctgggttttccttgttgttatttagaaggtgtccaatgtgaggagcagctggtggagtcgtggggggaggcctggtccaggccgggggggtccctgagactctcctgtggagcgtccggattcgactttgattacttattggatgagctgggtccgccaggctcgagggagggctggagtgggtgccacataaaggagatggaagtgagaactactttgngggctcgtgtggaaagggcgacttcaccatctccagagacaacgccaaagatcactgtatctgacaaatgaaacgatggtagagagtcgaaggacacgggtctgtattatttctaggtgcggagggggagcccggtntagtcgggtcgaccgtcggtggggccacggggacctcggtcaccgtcacaagtcacgcctaccacgacggccctacg

SEQ ID NO: 337926 - DNA, 627 bp, Homo sapiens
  misc_feature: GZ8MTXP02IFKBF.10.85.H08.1.454.CMB.2.raw
  modified_base (303)..(303): a, c, t, g, unknown or other
  misc_feature (303)..(303): n is a, c, g, or t
  modified_base (413)..(413): a, c, t, g, unknown or other
  misc_feature (413)..(413): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtcaatgtgaggagcagctggtggagtcgtgggggagcctggtccgaggccggggggtccctgagactctcctggtggagcgtccggattcgactttgatacttatggatgagcgtgggtccncaggctccgaggggagggctggagtgggtgccaacgagtaaaaggagagtaggaagtgagtaacttacgtttggtggggcttcgtggtagaacgggggccattcacctanctacagagacaacgccaaagacgtcactgtatcgtagaactaaagtgaaacgtattaggagaaggtaggtacgggaagggaaccgtacggggacttagggttaatttagttttcgtagggttcggaccggggtaagggggacgcccggggtaacgtttaaggtcggggtttacccggaccgttcggggttcgggggaaccccgtaaaccggggg

SEQ ID NO: 337927 - DNA, 583 bp, Homo sapiens
  misc_feature: GZ8MTXP02FUS52.10.85.H08.1.454.CMB.2.raw
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
  modified_base (511)..(511): a, c, t, g, unknown or other
  misc_feature (511)..(511): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattgggctgagctgggttttccttgttgttatttagaaggtgtccaatgtgaggagcagctggtggagtcgtgggggaggcctggtccaggccggggggtcctgagactctcctgtggagcgtccggattcgactttgatacttattggatgagctgggtccgccaggctccgagggaaggggctggaggtggggtggcccaaccagtaaaaggaagagtaggaagtgaagaactacgtttgtgggcttcgtggtgaaggggccgattccgaaccatcctaccagaagacaaacgccaaaagaagtcaactgtanctgacaaatgaaacntgagagagtgaggacaggctagtatatttcgtagtggacggtagggggacncccggggtacttaggtcgggtttaaccggacctcgggtacgggggccaacgggggtaacccctgggtacccg

SEQ ID NO: 337928 - DNA, 612 bp, Homo sapiens
  misc_feature: GZ8MTXP02I2TOQ.10.85.H08.1.454.CMB.2.raw
  modified_base (298)..(298): a, c, t, g, unknown or other
  misc_feature (298)..(298): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
  modified_base (496)..(496): a, c, t, g, unknown or other
  misc_feature (496)..(496): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccgggggggtccctggagactctcctgtggagcgtccggattcgactttgatacttattggatgagctgggtccnccaggctcgagggagggctggagtgggtgccacgataaaggaagagtggaagtgagaacttacgtttgtgggcttctggtggaaacggggccgtattccaccatcctaccagacgaacaacgccaaagaagtcaactgtatcnacaaatgaaacgatgngagagtcgaggacacgggcttaggtattacgttttcggnggtacgggacgggtagggggtacgtcccggggtacgttacgggttcggggttaaccggtacccggttcgggtaccgggggacccggtaaccgggggtacccgttacggggtacccg

SEQ ID NO: 337929 - DNA, 650 bp, Homo sapiens
  misc_feature: GZ8MTXP02F7E5W.10.85.H08.1.454.CMB.2.raw
  modified_base (295)..(295): a, c, t, g, unknown or other
  misc_feature (295)..(295): n is a, c, g, or t
  modified_base (554)..(554): a, c, t, g, unknown or other
  misc_feature (554)..(554): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggagcctggtccaggccggggggtccctgagctctcctgtggagcgtccggattcgactttgatacttatgatgagctggtccncaggctcgaggggagggctggagtgggtgccacaagtaaaggaagataggaagtgaagtaacttacgtttggtgggctcgtgggtaggaaacgggggcccgtaatttccaaccctagttccctacccgaagaacgaaccaaaccggaccaaaggaaacgttccaacttgtaactccgtagaacaaaattcggaaacgtagttaggtagaaggaggtaccggaaagggaccacggggtcttaggttaacttagttttcgngggttaggaccgggtaggggggacgccccgggtattaaggtttcggggttaccgggacccctttggtccgggggaccctaaccgggggtaaccccg

SEQ ID NO: 337930 - DNA, 693 bp, Homo sapiens
  misc_feature: GZ8MTXP02FVSDX.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggcccggggggtccctgagactctcctgtggagcgtccggattcgactttgatacttattggatgagctgggtccgccaggctccgaggggaggggcgtgggagtggggtggccgaccaagtaaaggaagatagggaagtgaagaacttacgttggtgggctcgtggtaggaaggggccgtaatttccaccatcctaccagaacgacaaacgaccaaaggaagtccactgtatctagacaaaagtcgaaacgtagttaggtagaaggagttacggggaacgggaaccgaaccggggtcgttaggttaaagtttaacgtttttccgttaagggttcgggaacgggggtacggggggtaacggtccccggggtacgttaaaggggtttccgggggttaccccgggggtaaaccccgttccgggggtttaccgggggggaacccccgttaaacggggggtaaaccccccgg

SEQ ID NO: 337931 - DNA, 610 bp, Homo sapiens
  misc_feature: GZ8MTXP02JC2AF.10.85.H08.1.454.CMB.2.raw
  modified_base (514)..(514): a, c, t, g, unknown or other
  misc_feature (514)..(514): n is a, c, g, or t
  modified_base (555)..(555): a, c, t, g, unknown or other
  misc_feature (555)..(555): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgagggccggggggtcctgagctctcctgtggagcgtccggattcgacttgattacttagttggatgagcgtcgggtcccgccgaggcctaccggaggggaacggggcgtgggaggtggggtcggaccacgaaagtaaaggaagagtaggaagtgaagtacttgttggtgggtctcgtggtaggaacggcgtacgttcactactctacgagacgaacaacgacaaagacgtcaagtgtatcgtagaactaaagtcgaaactgttgaggagacgtacggaagacgtacggtnttagttactttacgttcgagggtacggacggggacgggccncggtacgttaacggtcggtaccggaccgtcgggaccgggaccggtacggtacccg

SEQ ID NO: 337932 - DNA, 739 bp, Homo sapiens
  misc_feature: GZ8MTXP02J0IZJ.10.85.H08.1.454.CMB.2.raw
  modified_base (303)..(303): a, c, t, g, unknown or other
  misc_feature (303)..(303): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgagggcccgggggggtccctggagactctccgtgtggagcgtccggattcgactttgatacttattggatgagcgtgggtccnccgaggcctccgaaggggaggggctgggaggtggggtcggcccaaccgaagtaaaagggaaagagtgggaaagtggaagaacttacgtttggtggggcttcgtggtaggaaacgggggccgtattccgaacctagttccctacccgaagaacggaacccaaacgggaccccaaaagggtaaccgtaccaaccgtttaggtaacttacccgtaggaaccctaaaaagttcggaaaacggtagttagggttacgggaaaggtacggttacccgggaaaggggtaacccgaacgggggttcttaggttaatttacgttttcgagggttacgggaccgggggtagggggacgtcccggggatttaggttccgggggttaaccggacccgttcggggtcgggggtaccccgaacgggggttaaccccctggggtacccccg

SEQ ID NO: 337933 - DNA, 735 bp, Homo sapiens
  misc_feature: GZ8MTXP02G679M.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggccgggggtcctgagctctctgtggagcgtccgattcgacttgatacttattgatgagcgtgggtccgccaggctaccgaggggagggcgtgggaggtggggtcggccaacgaagtaaaaggagagtagggaagtgaagtaacttacgtttaggtcgggtccttcgttggtacgggaaacgggggtcccgaacgtttccgaacccgtattaccgtacccgaaaggaacgaaacccgaaaccggacccgaaaaggtaaacgtaccaacgttgtaactccgttaggaacctaaaagtgaaaacgtagtaggtaggaaggtaacggtcggaaacgggaaccgacggggtactttagggttaaactttagtttttccgtaggggttacgggaccgggggtaacggggggaccgtccccgggggttagttaacgggtttcccggggtttaccccggggtaaccctttccggggaccggggggtaaccccgaacgggggtttaaaccccccgg

SEQ ID NO: 337934 - DNA, 577 bp, Homo sapiens
  misc_feature: GZ8MTXP02JEVAZ.10.85.H08.1.454.CMB.2.raw
  modified_base (294)..(294): a, c, t, g, unknown or other
  misc_feature (294)..(294): n is a, c, g, or t
  modified_base (460)..(460): a, c, t, g, unknown or other
  misc_feature (460)..(460): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccggggggtcctgagactctcctgtggagcgtccggattcgactttgatacttattggatgagctgggtccnccaggctccgagggaggggctggagtgggtggcccacgataaaggagatggaagtgagaactactttggtgggctcgtggtggaaacgggggtcccgtaattccacctatcctacccagaacgacaaacgccaaaggaacgtccactgtatctgacaaatgaacgntgtgagagtcgaggacgacggctgtactatttcgtgtggcggaggggacgcccgggtactagtcggggttaaccggaccttcggtcgggggacctaacggggaacccctgggtaccc

SEQ ID NO: 337935 - DNA, 609 bp, Homo sapiens
  misc_feature: GZ8MTXP02G9NAY.10.85.H08.1.454.CMB.2.raw
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (469)..(469): a, c, t, g, unknown or other
  misc_feature (469)..(469): n is a, c, g, or t
  modified_base (500)..(500): a, c, t, g, unknown or other
  misc_feature (500)..(500): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccaggccggggggtccctgagactctcctgtggagcgtcggattcgactttgatacttattggatgagctgggtccncaggctccgaggggagggctgggagtgggtggccacagtaaagganatggaagtgaagtaactacgtttggngggcttcgtggtaggaaggggcccgtaattccaccatcctaccaagacgaacaacgaccaaagaacgtcaactgtaactctagacaaaatggaaactntaggtgaagaggtacgacggacaaccgggtnttagttacttagtttcgtgggtcggacggggacggggaccgtccggtagttaaggttcggggttaccggacccgtcgggtaccgggggaacccgtaaacggggtacccg

SEQ ID NO: 337936 - DNA, 707 bp, Homo sapiens
  misc_feature: GZ8MTXP02HPT49.10.85.H08.1.454.CMB.2.raw
  modified_base (576)..(576): a, c, t, g, unknown or other
  misc_feature (576)..(576): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgtttgttattttagaaggtgtccaatgtgaggagcagctggtggagtcgtgggggaggccgtggtccgagggccggggggtccctggagactctccgtgtggagcgtccggattcgactttgatacttagttggatgagcgtcggggtcccgccgaggcgtccgaaggggaacggggcgtgggaggtggggtcggaccaacgaagtaaaaggaagagtagggaagtagaacgtaaacgtttacgtttggtgggtccgttcgtggtaggaacggggtccgtacgttccaacccgtattcccacccgaagaaccgaacaaacccggaccaaaaggtacttccaacttgtacttacgtaggaaactaaaagtcggaaaactagtgtaggaagtaggtacggaacggtacgaccgggtnttaagttcgtttaacgtttttcgacggtgggaccgggaaagggggccgtacccggggtatttaagggttcggggtttaaacccggacccgttcggggtaccgggggaccccgtaaacgggggtaacccccg

SEQ ID NO: 337937 - DNA, 617 bp, Homo sapiens
  misc_feature: GZ8MTXP02GM0Z8.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtccctgagactctcctgtggagcgtccggattcgactttgattacttattggatgagctgggtccgccaggctccgaggggagggctggagtgggtggccacgaagtaaaggaagatagggaagtgaagaacttagtttggtggggcttcgtggtggaaacggggcccgtaattccgaacctattccctcccgaaggaacgaacaacgccaaagaacgtcactgtatctagacaaatgaaacgtatggtaggagaggtcggaggacgacggctgtattatttcgaggttggacgggtagggggacgcccggggtattaacggttcggggtcccggtacccgttcgggtcgggggaccgaacgggggtaaccccttggggtacccc

SEQ ID NO: 337938 - DNA, 704 bp, Homo sapiens
  misc_feature: GZ8MTXP02GQFWH.10.85.H08.1.454.CMB.2.raw
  modified_base (302)..(302): a, c, t, g, unknown or other
  misc_feature (302)..(302): n is a, c, g, or t
  modified_base (595)..(595): a, c, t, g, unknown or other
  misc_feature (595)..(595): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggcctggtccgaggcccggggggtccctggagactctcctggtggagcgtccggattcgactttgatacttatggatgagcgtgggtccnccgaggctccgaggggaaggggcgtgggaggtggggtggccaaccgaagtaaaagggaagagtagggaaagtgaagaacgttacgtttggtcggggtcttcgtagggtagggaaacgggggtcccgtaatttccgaaccctattccgtacccgaaggaacgaaaccaaacccggacccaaaaggtaacgtaccaacgttgttaacttcgtagaaacctaaaagttagaaacgtagttggagaaggtaggacggaagggacacgggtcttaggttaactttagtttttacgggngggtacgggtacggggacgggggtaccggtaccgggtacgttaacgggttccggggttacccggtaccggttcggggtaccgggggaacccggtaaccggggtaccccg

SEQ ID NO: 337939 - DNA, 574 bp, Homo sapiens
  misc_feature: GZ8MTXP02IH1AU.10.85.H08.1.454.CMB.2.raw
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (515)..(515): a, c, t, g, unknown or other
  misc_feature (515)..(515): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccggggggtccngagctctcctgtggagcgtcggattcgactttgattacttattggatgagctgggtccncaggctccgagggagggctggagtgggtgccacgataaaaggagagtggaagtgaagacttacgtttggtggggcttcgtgtgaaggggcgattcacctancctcagagacaacgaccaagactcactnatctagacaaatgaaacgatggtagagtagtacggaaggaccgaggctagttaacttatttcgtaggtcggacgggacgggggacnccggggtgttaggttcgggtttacggacccgtttcggacgggggtaccgtaaccggggg

SEQ ID NO: 337940 - DNA, 589 bp, Homo sapiens
  misc_feature: GZ8MTXP02J11QW.10.85.H08.1.454.CMB.2.raw
  modified_base (372)..(372): a, c, t, g, unknown or other
  misc_feature (372)..(372): n is a, c, g, or t
  modified_base (482)..(482): a, c, t, g, unknown or other
  misc_feature (482)..(482): n is a, c, g, or t
  modified_base (524)..(524): a, c, t, g, unknown or other
  misc_feature (524)..(524): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggcccggggggtccctgagactctcctgtggagcgtccggattcgactttgatacttattggatgagctgggtccgccaggctccgaggggagggctggagtgggtgccacagtaaaggagagtggaagtgaagaacttacgtttggnggggctcgtggtggaaggggcccgtatttccacccgattcccaccgaagaacgaaccaaaccgccaaaagaacgttcaacgttgtaatccgtagaccaaaagtgaaacgntgtagaggagtcggaaggacacgggcttggtaatagtttcgnggtggacgggaggggcgccggtagtggttcggtccggaccttcggcggggaccgacgggtacccg

SEQ ID NO: 337941 - DNA, 636 bp, Homo sapiens
  misc_feature: GZ8MTXP02JSAOK.10.85.H08.1.454.CMB.2.raw
  modified_base (510)..(510): a, c, t, g, unknown or other
  misc_feature (510)..(510): n is a, c, g, or t
  modified_base (537)..(537): a, c, t, g, unknown or other
  misc_feature (537)..(537): n is a, c, g, or t
  modified_base (553)..(553): a, c, t, g, unknown or other
  misc_feature (553)..(553): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctgggtccgagggcccgggggggtccctggacgactctcctgtggagcgtccggattcgactttgatacttattggatgagctgggtccgccaggcctccgaggggaggggctgggagtggggtgccacgaagtaaaggaagatagggaagtgaggtaaacttacgtttggtggggctcgtggtcggaaagggggccctaagtttccaccctaagttccctcccaagaaacggaaccaaaaccggacccaaaaggaagttaccaacgttgtatccgtagaacaaaagtgaaacgntaggtagagacgtcgaaggacacggtnttagtacttatttcgnggtcggacgggacggggacgtccggtagtaacggttcgggttaccggaccgtacgggtaccggggacccgtaacgggtacccg

SEQ ID NO: 337942 - DNA, 561 bp, Homo sapiens
  misc_feature: GZ8MTXP02JCIE0.10.85.H08.1.454.CMB.2.raw
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccggggggtccctgagactctcctgtggagcgtccggattcgactttgatacttattggatgagctgggtccnccaggctccgaggggaggggctggagtgggtgccacataaagganagtggaagtgagaactactttggnggctntggtagaagggccattccactatctccagacgacaacgccaaagacgtcactgtanctgacaaagtgaacgatgngaagcgtcggaggacacggtntagtattgttcgnggcggacgggaggggacgccggtacgttaggtcgggttccggaccgttcgggacgggggacccgacggggtaccctggtaccc

SEQ ID NO: 337943 - DNA, 535 bp, Homo sapiens
  misc_feature: GZ8MTXP02FXHV0.10.85.H08.1.454.CMB.2.raw
  modified_base (368)..(368): a, c, t, g, unknown or other
  misc_feature (368)..(368): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggcctggtccaggccggggggtcctgagactctcctgtggagcgtccggattcgactttgatacttattggatgagctgggtccgccaggctccgagggaaggggctgggagtgggtggccaccataaaggagatggaagtgagaacttacgttgngggctctgtgaagggccattcaccatctccagagacaacgccaaagaacgtcactgtatctagacaaaatgaaacgtatgtagagagtcgaaggacacgggctgtattatttcgngtgcggaggggcnccggntaagtcggtacggacctgtggggccaggtacccg

SEQ ID NO: 337944 - DNA, 681 bp, Homo sapiens
  misc_feature: GZ8MTXP02G950A.10.85.H08.1.454.CMB.2.raw
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttcttgttgttatttagagtgtcaatgtgaggagcagctggtggagtcgtgggggagccgtggtccgaggccggggggtccctgagactctccgtggtggagcgtccggattcgactttgatacttatggatgagcgtgggtcccgcgaggctaccggaggggaaggggcgtgggagggtggggtcggcccgaaccgaagtaaaagggaagagtagggaaagtgaaagtaacgttacgtttggtggggtcttcgtaggtaggaacggggtccgtaatttcccgaaccattccctaccgagaacgaaaccacgaccgaaagaacgtcactgtaatctagaacaaaagtagaaacggtataggtaggaagtaacggtacggaacgggaaccgtaacgggcgtttaggttaacttttacgttttcgtagggttacgggacgggggtaaacgggggccgtaccgggtaacgttaggtttccgggggttacccgaccgtttcgggtacccggggggtaccaacccggggg

SEQ ID NO: 337945 - DNA, 679 bp, Homo sapiens
  misc_feature: GZ8MTXP02GXH09.10.85.H08.1.454.CMB.2.raw
  modified_base (384)..(384): a, c, t, g, unknown or other
  misc_feature (384)..(384): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagcctggtccgaggccggggggtcctgagactctcctgtggagcgtccggattcgactttgattacttattggatgagcgtcgggtccgccaggcctccggaggggaaggggcgtgggaggtggggtcggaccaccgaagtaaaggagataggaagtgaagacttagtttggngggtctcgtggtggaaacggggcccgtaatttccaacctagtcctacccagacgaacaaacgccgaaagaacgtcaacgtgtaactgtacgaacaaaagttcgaaaacggattaggtaggaaagtacgggttaccggaaaggggaacccgacggggtcctttaggttaaacctttagtttttccggtggtacgggacggggacgggggaccggtcccgggtagtttaacgggttcggggttacccggtacccgttccggggtaccgggggtacccgtaaccgggggtaacccccg

SEQ ID NO: 337946 - DNA, 570 bp, Homo sapiens
  misc_feature: GZ8MTXP02JZTBB.10.85.H08.1.454.CMB.2.raw
  modified_base (369)..(369): a, c, t, g, unknown or other
  misc_feature (369)..(369): n is a, c, g, or t
  modified_base (445)..(445): a, c, t, g, unknown or other
  misc_feature (445)..(445): n is a, c, g, or t
  modified_base (524)..(524): a, c, t, g, unknown or other
  misc_feature (524)..(524): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccagggccgggggggtccctggagactctcctgtggagcgtccggattcgacttgatacttattggatgagctgggtccgcaggctccgaggggagggctggagtgggtgccacgagtaaaggagatggaagtgagaactagttggngggctgtgtagagggccattcaccatcctcagacgacaacgccaaagagtcactgtactctgacaaatcgaaaccngttagtgaaggacggtcggaaggaccgacgggtcttagtatttactttcgaggtcgacggggtagggggacgcccggtntaaggttcgggtacggacccgtggcgggggacccaggggtaccccg

SEQ ID NO: 337947 - DNA, 600 bp, Homo sapiens
  misc_feature: GZ8MTXP02GXK15.10.85.H08.1.454.CMB.2.raw
  modified_base (306)..(306): a, c, t, g, unknown or other
  misc_feature (306)..(306): n is a, c, g, or t
  modified_base (534)..(534): a, c, t, g, unknown or other
  misc_feature (534)..(534): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgaggcccggggggtccctggagactctccgtgtggagcgtcggattcgacttgatacttattggatgagctgggtccncgaggctccgagggagggctggagtgggtgccacagtaaaggagagtggaagtgagaacttacgtttggtggggctcgtggtagaacggggccgtattccgaaccctatcctccaagacgaaccaaacgccaaagaacgtccactgtaatcgtagacctaaaagtcggaaacgtattggagaggtacgtacggaaggaaccgacgggtcttaggttattattttcggnggtacgggacgggaggggacgccggtgttacggtcgggtaccggaccgtcgggcggggaccgaagg

SEQ ID NO: 337948 - DNA, 584 bp, Homo sapiens
  misc_feature: GZ8MTXP02F398L.10.85.H08.1.454.CMB.2.raw
  modified_base (294)..(294): a, c, t, g, unknown or other
  misc_feature (294)..(294): n is a, c, g, or t
  modified_base (472)..(472): a, c, t, g, unknown or other
  misc_feature (472)..(472): n is a, c, g, or t
  modified_base (513)..(513): a, c, t, g, unknown or other
  misc_feature (513)..(513): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtcctgagactctcctgtggagcgtcggattcgacttgattacttattggatgagctgggtccncaggctccgagggagggctggagtgggtggcccacaagtaaaggagagtaggaagtgaagtaacttactttggtgggcttcgtggtagaaacggggtccgtaattccaacctatcctaccagagaaccaaacgccaaaagagtccaactgtactacgtagaacaaaattagaaacgtntggtagagacggtacgaggtacacgggtctagtatatttcngtggcggaggggacgccgtagtagttcgggtcgtacctgggtacggggacctacgggaacccgtggtaccc

SEQ ID NO: 337949 - DNA, 626 bp, Homo sapiens
  misc_feature: GZ8MTXP02IEZQ3.10.85.H08.1.454.CMB.2.raw
  modified_base (391)..(391): a, c, t, g, unknown or other
  misc_feature (391)..(391): n is a, c, g, or t
  modified_base (485)..(485): a, c, t, g, unknown or other
  misc_feature (485)..(485): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtcaatgtgaggagcagctggtggagtcgtgggggagccgtggtccgaggccggggggtccctggagactctcctgtggagcgtccggattcgactttgattacttagttggatgagcgtgggtccgccgaggctccggaggggaagggctggaggtgggtcgaccacgaagtaaaggagagtagggaagtgaagtaacgttacgtttggnggtctcgtgtagggaacgggcatttcaacctatccgtacaagagaaccaacgaccaaagaacgtcacgtagtactctagactaaagtgaaacgntggagaagacggtcggaaggaccgagggtacttggtaatttagtttcgtaggttcggaccgggtagggggtccgtacccgggtgttaacggttcggggttcccgaaccgttcggggtacgggggacccgtaaacccggggg

SEQ ID NO: 337950 - DNA, 596 bp, Homo sapiens
  misc_feature: GZ8MTXP02I0O1W.10.85.H08.1.454.CMB.2.raw
  modified_base (299)..(299): a, c, t, g, unknown or other
  misc_feature (299)..(299): n is a, c, g, or t
  modified_base (473)..(473): a, c, t, g, unknown or other
  misc_feature (473)..(473): n is a, c, g, or t
  modified_base (513)..(513): a, c, t, g, unknown or other
  misc_feature (513)..(513): n is a, c, g, or t
tcagcatagtagtgcacgaccggtgctcgatttagtatcactcagtcgcggggctcagagaggagccttagccctggactcaaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccncaggctccgagggagggctggagtgggtgccacgataaaggagagtggaagtgagaacttacgtttggtgggcttcgtggtaggaaacggggccgtattccgaacctagtcctaccagaacgaaccaaaccgacccaaagtaacgtccaactgtatctagacaaaatgaaacgntagtgaagagtacggaggacacggctagtacttatttcgnggtggacggagggggtacgcccggtagttaacggtcggttaccgggtacctcgggcgggggtacccgaacggggtaaccccgg

SEQ ID NO: 337951 - DNA, 623 bp, Homo sapiens
  misc_feature: GZ8MTXP02JRLTR.10.85.H08.1.454.CMB.2.raw
  modified_base (459)..(459): a, c, t, g, unknown or other
  misc_feature (459)..(459): n is a, c, g, or t
  modified_base (479)..(479): a, c, t, g, unknown or other
  misc_feature (479)..(479): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaagtgtccaatgtgaggagcagctggtggagtcgtgggggagcctggtccgaggccggggggtccctgagactctcctgtggagcgtccggattcgacttgatacttattggatgagcgtgggtcccgccgaggctccgaggggaaggggcgtgggaggtggggtggccaaccgagtaaaagggagagtagggaagtgaagtacttatttggtgggctctggtgaaaggggccgattccgaaccatcctacccagacgaacaacgccaaagaacgtcactgtanctagacaaaagtcgaaacgnttaggagaggagtccggaaagggacctacgggctttaggtaaacttgttttccgaggttcggaccgggtaagggggcgccccgggtgttaacggtttcggggtaccgggtaccctttcgggtcggggggaccctaacccggggg

SEQ ID NO: 337952 - DNA, 594 bp, Homo sapiens
  misc_feature: GZ8MTXP02I6FSJ.10.85.H08.1.454.CMB.2.raw
  modified_base (427)..(427): a, c, t, g, unknown or other
  misc_feature (427)..(427): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccaggcccgggggggtccctgagactctcctgtggagcgtccggattcgactttgatacttattggatgagctgggtccgcaggctccgagggaaggggctggagtggggtggccaccgataaaaggaagagtaggaagtgaacgtaacttacgtttgtgggggtctcgtggtagaaggggccagttcaccatctccaganacaacgccaagaagtcactgtaatctagacaaagtagaaacgtaagtgtaggaagtaggtacggagggaactacggggcttaggtacttaatttcgtagttggccggaagggggcgaccgggtcgtaaggtcggttaccgggacctcgggtcggggacccgaacggg

SEQ ID NO: 337953 - DNA, 585 bp, Homo sapiens
  misc_feature: GZ8MTXP02IHZLD.10.85.H08.1.454.CMB.2.raw
  modified_base (468)..(468): a, c, t, g, unknown or other
  misc_feature (468)..(468): n is a, c, g, or t
  modified_base (504)..(504): a, c, t, g, unknown or other
  misc_feature (504)..(504): n is a, c, g, or t
  modified_base (525)..(525): a, c, t, g, unknown or other
  misc_feature (525)..(525): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgacttgatacttattggatgagctgggtccgcaggctccgaggggagggctgggagtgggtggccacaagtaaaggaagatggaagtgaagaactacgtttggtgggctcgtgtggaaacgggccgtattccgacccatcctaccagacgacaaacgccaaaggacgtcaactgtatcgtagacaaaagtgaacgtatagngaagaggtacgaggacagggtctagtattatttcgnggtacggcggtaagggggacnccgggacttaagttcggggtaccgaccgtgggttaccgggggacctaacggggtaccccg

SEQ ID NO: 337954 - DNA, 574 bp, Homo sapiens
  misc_feature: GZ8MTXP02IG2QJ.10.85.H08.1.454.CMB.2.raw
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
  modified_base (459)..(459): a, c, t, g, unknown or other
  misc_feature (459)..(459): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtccctgagactctcctgtggagcgtccggattcgactttgatacttatggatgagctgggtccnccaggctccgagggaaggggctggagtgggtggccaccgagtaaaggaagataggaagtgaagtaacttacgtttggtgggctctggaggagggccgatttcaccatcncccaagacgacaaccgcaagaagtcaactgtatctagacaaagtcgaaagnttggagaaggagtcgaagggacacgggcttgtaattagtttctggtggacggagggggactccggacttaagttcgggtcggtaccctggtcgggggacccaagggggtaccccg

SEQ ID NO: 337955 - DNA, 724 bp, Homo sapiens
  misc_feature: GZ8MTXP02IG1M7.10.85.H08.1.454.CMB.2.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (571)..(571): a, c, t, g, unknown or other
  misc_feature (571)..(571): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggagcctggtccgaggccggggggtcctgagactctctgtggngcgtcgattcgactttgatacttattggatgagctgggtccnccaggctcgagggagggctggagtgggtcgccacaagtaaaggagagtggaagtgaagtaacttacgtttaggtgggtacttcgttgggtaggaaacgggggtcccgtaacgtttccaaaccgtattacccgtacccaaagggaacgaaacccgaaaaccggacccaaaaaaggtaaacgttcccaaacgtttaggttaaactcctaggaaacctaaaaagttggaaaacgttagtacgggttagaaggtacggtccggaaaggaccgtaaccggggttnttaagttaatttacgttttcggtagggtacgggacgggtaaagggggaccgtacccgggttacgttacggttaccggggtttaaccggtaccccggtttcggggtaccgggggtaccccggtaaaccggggtaccccggtttacggtaccccg

SEQ ID NO: 337956 - DNA, 643 bp, Homo sapiens
  misc_feature: GZ8MTXP02G0R9A.10.85.H08.1.454.CMB.2.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctgggtggagtcgtgggggagcctgggtccagggccggggggtccctggagactctcctggtggagcgtccggattcgactttgatacttatggatgagctgggtccncaggctcgagggaggctgggagtgggngccacgaagtaaaggagataggaagtgaagtaacttacgtttggngggtctcgtggtaggaacggggccgtaattccaacctatcctaccaagacgaacaaaccgtaccaaaaggacgtaccaacgttagtaatccgtagaaccaaaagttgaaacgtagttacgagaaggtaggaccggaaggaccgacgggtctaggttaaattgtttcctggtgggaccgggagggggtacgccccggtagttaacggttcgggggttacccggacccgtttcgggtaccgggggtaacccaacggggggtttaacccccg

SEQ ID NO: 337957 - DNA, 654 bp, Homo sapiens
  misc_feature: GZ8MTXP02FQSF4.10.85.H08.1.454.CMB.2.raw
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (567)..(567): a, c, t, g, unknown or other
  misc_feature (567)..(567): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgagggccggggggtccctggagactctccgtggtggagcgtcggattcgacttgatacttattggatgagcgtgggtccncaggctcgagggaggctggagtgggtcgccacagtaaaaggagataggaagtgagtaacttacgtttggngggcttcgtggtaggaacggggcctattccaacctatcctaccgaagacgaacaaacggaccaaaagacgtccaacttgtaactctagaaaccaaaagtcggaaacgtattaggaggaaaggacgttacggaacggaacccgtaagggtcttaggttaaattatttccggtgggtaggaccggggaaagggggtaccncccggggtactaaggtttcggggttaacccggaacccgttcgggtacgggggccctaaacgggggaacccccttggggttaaccccc

SEQ ID NO: 337958 - DNA, 764 bp, Homo sapiens
  misc_feature: GZ8MTXP02FNZ6N.10.85.H08.1.454.CMB.2.raw
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccgggggggtccctgagactctccgtgtggagcgtccggattcgactttgattacttattggatgagcgtgggtccncgaggctccgagggaggctggagtgggtgccacaagtaaaggagagtaggaagtgaagtaactacgtttggngggcttcgtggtaggaacggggtcctattccaacctatccctaccgaaggaacggaacccaaaaccggacccgaaaaggtaacgtacccgtaaacgttacggttaacttaccgttaaggaaacctaaaagttacgggaaaaccggtaggttagggttacgggaaaagggtaacggttaccggggaaacggggtaacgtaaccgggggtctttagggtttaatttaaccgtttttccggtaggggttacgggaccgggggttaaaggggggaccggtcccggggttacgttaaacgggtttccgggggtttaacccgggtaacccgtttccgggggttaccggggggaccccgtaaaacgggggtaaccccccggtttggggtttaacccccg

SEQ ID NO: 337959 - DNA, 562 bp, Homo sapiens
  misc_feature: GZ8MTXP02FJCWO.10.85.H08.1.454.CMB.2.raw
  modified_base (528)..(528): a, c, t, g, unknown or other
  misc_feature (528)..(528): n is a, c, g, or t
  modified_base (553)..(553): a, c, t, g, unknown or other
  misc_feature (553)..(553): n is a, c, g, or t
  modified_base (555)..(562): a, c, t, g, unknown or other
  misc_feature (555)..(562): n is a, c, g, or t
tcagcatagtagtgcacgaccggtgctcgatttagtatcactcagtcgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccattcaccatctcagagacaacgcaagaagtcactgtatctgacaaatgaacgatgtgagagtcgaggacacggctgtatatttctgtgcgaggggagccggctagtggttcggacctcgtggggccaggggaacccctggtccaccgtcctcatcacgccctcccaaccgacggggccccattccggtcccttcccccgtggcccgccctcgcctcccgaggcgccaccctccgagacgcacacgccggcccgtggggctcgcctgggtaccgaaaggtacccttaccttccccaacttacctatcgcgtggacggccggggntcgggacaaacgggccgacagtagngnnnnnnnn

SEQ ID NO: 337960 - DNA, 618 bp, Homo sapiens
  misc_feature: GZ8MTXP02JRG7E.10.85.H08.1.454.CMB.2.raw
  modified_base (262)..(262): a, c, t, g, unknown or other
  misc_feature (262)..(262): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccgacgggccggggggtccctggacgactctccgtgtggngcgtcggtattcgacttgatacttagtggatgagcgtgggtccgcgaggccgtcggaggggaggggctagggaggtggggtcgccaacgaaagtaaaggaagagtaggaagtagaacgtaacttagttgtgggctgtggtaggacggcgtatcaactgtccacgagacgacaaacgacaaggaactcatgtatcgagaacaaagtcgaactagtgtagaggaacgtcgggaaacgtacgacggtcttagttaaacgttcgtttgtagggacgtacgggggaggggtaccgtcggtacgttaaggtcggggtttaccggaccgtttgggacccgggggaccgaaccggttaacccgg

SEQ ID NO: 337961 - DNA, 650 bp, Homo sapiens
  misc_feature: GZ8MTXP02F4G7B.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttatttagaaggtgtccaatgtgaggagcagctggtggagtcgtgggggaggccgtggtccgagggcccgggggggtccctggagactcgtccgtgtggagcgtccggattcgactttgattacttattggatgagcgtcgggtccgccgaggcctccggaggggaacggggctggggaggtggggtcggcccaacgaagtaaaagggaagatagggaaagtgaagtaacttacgtttggtgggctcgtggtaggaacgggccgtatttccacctatcctaccagaagaccaacgaccaaagaacgtccaagttgtactctaggaacaaaagtgaaacgtagtgtaggagaggtacgaaggaccgacgggtctagttaacttcgtttcgtggttagggacggggacgggggtacgccccgggtagttaaggttcggggtttccggaacccgttcgggtacgggggaccccgtaagggggtacccccg

SEQ ID NO: 337962 - DNA, 589 bp, Homo sapiens
  misc_feature: GZ8MTXP02FUES8.10.85.H08.1.454.CMB.2.raw
  modified_base (375)..(375): a, c, t, g, unknown or other
  misc_feature (375)..(375): n is a, c, g, or t
  modified_base (466)..(466): a, c, t, g, unknown or other
  misc_feature (466)..(466): n is a, c, g, or t
  modified_base (504)..(504): a, c, t, g, unknown or other
  misc_feature (504)..(504): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggcccgggggggtccctgagctctcctgtggagcgtccggattcgacttgatacttatggatgagctgggtccgccaggctccgaggggagggctggagtgggtgccacagtaaaggagagaggaagtgaagtaacttacgtttggngggctcgtggtaggaacggggtccgattcgacctatcctaccgagaacgacaacgcaaagacgtcactgtactctgacaaagtgaaacgtntgagagagtcggaaggaccaggtctagtacttatttcngggtggacggagggggactccgggtagttaacggttgggttacccggaccttcgggacgggggaccctaacgggggtaacccccg

SEQ ID NO: 337963 - DNA, 546 bp, Homo sapiens
  misc_feature: GZ8MTXP02G80K9.10.85.H08.1.454.CMB.2.raw
  modified_base (332)..(332): a, c, t, g, unknown or other
  misc_feature (332)..(332): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccgaggggaaggggctggagtgggtggccaccataaaggaagatggaagtgagaactactttgtgggctctgtgaagggccattcaccatctccagagacaacgccaaagaagtcactgtatctgcaaatgaacgatgtgagagtcgaggacacggctgtatatttctgtgcggagggganccggctagtggttcggacctcgtggggccaggggaaccctggtccacgtctcatcagccctcaaccaagggcccatccggtccttccccctggccgccctgcctccgaggcgcacctcgagacgcacacggcgccctggctcgcctggtacaaaggcctacttcccactaactagtcgcgtacgaggcgggcctggacaagggcgacgtanagn

SEQ ID NO: 337964 - DNA, 699 bp, Homo sapiens
  misc_feature: GZ8MTXP02J1LI3.10.85.H08.1.454.CMB.2.raw
  modified_base (603)..(603): a, c, t, g, unknown or other
  misc_feature (603)..(603): n is a, c, g, or t
tcagcatagtagtgcacgaccggtgctcgatttagtatcactcagtcgcggggagggtctcagagaggagccttagccctggactccaaggcctctccacttggtgatcagcactgagcacagaggactcaccatggaattggggctgagctgggttttccttgttgttattttagaaggtgtcaatgtgaggagcagcgtggtggagtcgtgggggaggcctggtccgagggtcccgggggggtccctgacgactctccgtgtggacgcgtccggattcgactttgatactttagttggatggaggtcgttggggtccccgaccagggtccgtaccgagggggaaagggggtctggggtaggtgggggtcggaccaaccgaaagtaaaagggaagagtaggggaataggaagtaaacgttacgtttgggtggggcttcgttggagggaaacggggtccgatttcccgaacctataccctaccgagaaacggaaccaaacgtaccgaaaaaggtacgtaccacgttagtactttcgacgaaactaaaagttacgaaaacggttaagttgagggaagtacggtacggaaggtaccgaacgggtnttacgtattagttcgtaggcggacggggtacggggactcgggtaacgttagggtccgggttccggacccggttcggaccggggtaccgtaaccggg

SEQ ID NO: 337965 - DNA, 666 bp, Homo sapiens
  misc_feature: GZ8MTXP02I0EM6.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggaggccgtggtccgagggccggggggtccctggacgactctccgtggtggagcgtccggattcgtactttgattacttagttggatgagcgtgggtccgccgaggcctaccggaggggacggggcgtgggaggtggggtcggacccgaacgaaggtaaaaggaagagtagggaagtggaagtaaacttacgtttggtgggtcttcgtgggtagggaacggggtccgtacttaccaacctatccctaccgaagaccgaaccaaccggaccaaaagtacgtccaactgtactcgtagaacaaagtcgaaaacgtgtaggaggagaggtcggaaacggacgacggtattagttaacttagtttcgtggtacgggacggggaaggggtacgccgggtattaggttcggggtaaccgtaccgtcgggtacggggaccgtacggggtaccccgtggtaccccg

SEQ ID NO: 337966 - DNA, 619 bp, Homo sapiens
  misc_feature: GZ8MTXP02I9GSW.10.85.H08.1.454.CMB.2.raw
  modified_base (502)..(502): a, c, t, g, unknown or other
  misc_feature (502)..(502): n is a, c, g, or t
  modified_base (530)..(530): a, c, t, g, unknown or other
  misc_feature (530)..(530): n is a, c, g, or t
  modified_base (546)..(546): a, c, t, g, unknown or other
  misc_feature (546)..(546): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgaggccggggggtccctggagactctcctgtggagcgtcggattcgacttgatacttatggatgagcgtggtccgccaggctccgaggggaggggcgtgggaggtggggtcggccaccgaagtaaaggaaagagtagggaagtgaagtaacgttacgtttaggtgggtcttcgttggtaggaaacggggccgtaactttccgaaccctatccctacccgagaacgaacccaaacgccaaagaagtccaactgtaactcgtagacaaagttgaaacgtntggtagaagaggtcgaaggacacgggtnttagttacttgtttgnggtcggacggggacggggacgtccggtagttaaggtcgggtaccggcgtcgggcggggaccgtacgggacccg

SEQ ID NO: 337967 - DNA, 642 bp, Homo sapiens
  misc_feature: GZ8MTXP02FYUS9.10.85.H08.1.454.CMB.2.raw
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (569)..(569): a, c, t, g, unknown or other
  misc_feature (569)..(569): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtccaatgtgaggagcagctggtggagtcgtgggggaggccgtggtccgagggccggggggtcctgagactctccgtgtggagcgtcggtattcgactttgattacttatgatgagcgtggccncnggctccgaggggaggctggagtggggtcgccaacgaagaaaggaagagtagggaagtgaagtaacttacgttgtgggctcgtggtaggaacgggcctaatttccgaacctatccgtaccaagaacgaaccaaacgacccaaaagaacgttacaacttagtactaccgtagaaacctaaaagtgaaacgtagtgtaaggaaggtacgtacggaaggaccgaggtcttaggttacttagttttccgaggttacggacggaaagggggtcncccggggtataaggttcggggtttacccgacccggtttcgggacgggggaccccgtaacggggtaaacccccg

SEQ ID NO: 337968 - DNA, 761 bp, Homo sapiens
  misc_feature: GZ8MTXP02FTGWN.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttatttagaaggtgtccaatgtgaggagcagctggtggagtcggtgggggagccgtggtccgagggcccggggggtccctgagactctccgtgtggagcgtccgtattcgactttgattacttagtggatgagcgtgggtcccgcgaggcgtaccgaggggtaagggcgtgggaggtgggtcgacccaacgaagtaaaagggaagagtacgggaaagtgaaagtaacgtttacgtttggtacgggtctcgtagggtaggaaacgggggcccgtaatttcccgaacctagttccctacccgaaaggaaccgaaaccaaacccggaccaaaaggtaaacgtacccctaacgttaagttacttacccgtaggaaacctaaaaagttcggaaaacgttagttaggtaggaaagggttacggtacggaaacgggaacccgtaacggggtcctttaaagtttaacgtttacgtttttttaccgggtaggggtacgggacgggggtaacgggggtaccggtcccgggttaacgtttaagggttccggggttacccggtacccggttccggggtaccgggggaaccccgtaaccggggtaaccccg

SEQ ID NO: 337969 - DNA, 703 bp, Homo sapiens
  misc_feature: GZ8MTXP02IRSG2.10.85.H08.1.454.CMB.2.raw
  modified_base (582)..(582): a, c, t, g, unknown or other
  misc_feature (582)..(582): n is a, c, g, or t
  modified_base (602)..(602): a, c, t, g, unknown or other
  misc_feature (602)..(602): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttatttagaaggtgtccaatggtgaggagcagcgtggtggagtcgtgggggagtccgtgggtccgacgggcccgggggggtccctaggacgtaccttcgtccgtggtggacgtccggttccggtattcgtactttgacttacttagttggatgagtccgtcgggtcccaccgtaggcctaccgggaaggggaacggggtctggggaggtcggggtcgaccccaacgtaaaggtaaaacgggagtagtacgggaaagtcgaaacgtaactttcgtttgggcgggtccttacgtgggtacggaacggggtcctaattcccgaaacgtctacccgtaccgaaggaacgaaccgaaaaccgaccgaaaaggtaaactcctaaagtcgtaaactcaggaactaaaagtgaaacggtatgggtagaagngtacggaggacctaacggtnttagtcttagtttcggnggnggacggggagggacgtcggtacgttcggttcgggtaaccggtccgtacggggacgggacccgtaacgggtccctcggtacc

SEQ ID NO: 337970 - DNA, 610 bp, Homo sapiens
  misc_feature: GZ8MTXP02HZPRL.10.85.H08.1.454.CMB.2.raw
  modified_base (308)..(308): a, c, t, g, unknown or other
  misc_feature (308)..(308): n is a, c, g, or t
  modified_base (478)..(478): a, c, t, g, unknown or other
  misc_feature (478)..(478): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggtttttccttgttgttattttagaaggtgtccaatgtgaggagcagctggtggagtcgtgggggaggcctggtccgagggccggggggtccctggacgctctccgtggtggagcggtccggattcgactttgatacttagtggatgagcgtgggtccnccgaggctccggaggggaagggcgtgggaggtggggtcgacccaacgaaagtaaaagggaaggagtagggaaagtagaagtaacgttacgttttgggcggtctcgtgtacgggaacgggcctagttccaccacttcaccgagacgaacaacgacgaaagacgtacacgtntaacttcagaaacaaagtgaaaacgtgtagagaacggagtacgggaagacgacggtctaggttaattatttcgtggacgcgggaagggcgtcgagttgtcggtacgcgtcggtcggggacctacgggacccg

SEQ ID NO: 337971 - DNA, 706 bp, Homo sapiens
  misc_feature: GZ8MTXP02H48YD.10.85.H08.1.454.CMB.2.raw
  modified_base (299)..(299): a, c, t, g, unknown or other
  misc_feature (299)..(299): n is a, c, g, or t
tcagcatagtagtgcacgaccggtgctcgatttagtatcactcagtcgcgggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctccgtggtggagcgtcccggtattcgactttgatacttatggatgagcgtgggtccnccgaggcctccggaggggaaggggcgtggaggtggggtggccaaccgaagtaaaaggaaagaagtaggggaaagtaggaacgtaaaacgttacgtttgggtagggtcttcgtggtagggtaaacgggccgtagttccaaccgattccctacccgaagaacgaaccaaaccggacccgaaagaaacgtacaaccgttgaattcctagaacaaagtagaaacgtatggtaggagtacgtacggaacggacgtaacggtcttagtaattaagtttcctagggtttaccggacgggtaacgggggacggtaccccggggtaccttaaggggttcggggttccccgggtaaccgttccggtacggggggaccccgtaaacgggggtaaacccccgtttcggggttaaccccg

SEQ ID NO: 337972 - DNA, 665 bp, Homo sapiens
  misc_feature: GZ8MTXP02JTLGV.10.85.H08.1.454.CMB.2.raw
  modified_base (303)..(303): a, c, t, g, unknown or other
  misc_feature (303)..(303): n is a, c, g, or t
  modified_base (527)..(527): a, c, t, g, unknown or other
  misc_feature (527)..(527): n is a, c, g, or t
  modified_base (566)..(566): a, c, t, g, unknown or other
  misc_feature (566)..(566): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccaggcccgggggggtccctgacgactctcctgtggagcgtccggattcgactttgatacttatggatgagtctgggtccnccaggctccgaggggaagggctgggagtcggggtgccgaccaagtaaagggaagtagtagggaaagttgaagtaaacgttacgtttaggtggggtcttacgtggttacgggaaacggggcccgtaatttccgaacccaagttcccgtaccaaggacgaaccaaaccggccaaaggaacttccgaacgttaggtaacttcgtggaacaaaagttcggaaaacgtntagggttagaggtacggtccgaagggctaacccggggtnttggttaacttatttcggtggtcggggaccggtaagggggcgaccggtcgttaagtcgggtttaccggacgttcggtcggggaccacgggggtaacccc

SEQ ID NO: 337973 - DNA, 661 bp, Homo sapiens
  misc_feature: GZ8MTXP02JMWKN.10.85.H08.1.454.CMB.2.raw
  modified_base (568)..(568): a, c, t, g, unknown or other
  misc_feature (568)..(568): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttatttagaaggtgtcaatgtgaggagcagcgtggtggagtcgtgggggagccgtggtccgaggccggggggtccctggagctctccgtgtggagcgtcggattcgacttgattacttagttggatgagcgtcgggtccgccgaggcctccggaggggaaggggtcgtggggaggtggggtcggaccaaccgaagtaaaaggaagtagtagggaagtgaagtaacgttacgttggtcgggtctcgtggtacggaacggggcctagtttcccaccctatccgtaccgaagaacgaaccaacccgacaaaagggaacgttccaaacgttgtaacttaccgaggaaactaaaagtacggaaacttaggttagacggaaggttaggaccggaaagggaccctacggggtnttaggttatttagtttcgagggtggacgggtacggggacgtcccggattaaggtcgggtaccgcgttggggacgggtacccgacgggtacccg

SEQ ID NO: 337974 - DNA, 683 bp, Homo sapiens
  misc_feature: GZ8MTXP02H7QBI.10.85.H08.1.454.CMB.2.raw
  modified_base (559)..(559): a, c, t, g, unknown or other
  misc_feature (559)..(559): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggccgggggtcctgagactctcgtgtggagcgtcggtattcgactttgatacttatggatgagcgtgggtccgccgaggcctaccggaggggaggggctgggaggtggggtcggacccaacgaagtaaaagggaagagtggaagtgaagtaacgttacgtttggtagggcttcgtggtagggaaagggtccctaagttccaccgaatcctacccgagacgaaccaacgaccaaagaacgttcacttgtactctagactaaagtacgaaacgtataggtaggaaggtacgtaacggaggtaaccgacgggtacttagtttaacgttacgtttttacggnggtacgggacggggaaacggggtaccggtccgggtacgtttacggttaccggggttaacccggtaccggttaccgggggaccgggggtacccggaaccggggttaaacccgttccggtaacccg

SEQ ID NO: 337975 - DNA, 742 bp, Homo sapiens
  misc_feature: GZ8MTXP02HVD0B.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattgggctgagctgggttttccttgttgttattttagaaggtgtccaatgtgaggagcagctggtggagtcgtgggggaggcctggtccgagggccggggggtccctgagactctctgtggagcgtccggatcgtactttgatacttattggatgagtcgtcgggtccgccgaggcctccggaagggggaacggggtctggggaggtggggtcggacccgaaccgtaaagtaaaaggggaagtagtaggggaaagtgaaggtaaacctttacgttttgggtgggtccttcggttgggtaggggaaacgggggtccctacgtttaccaacccgtaattcccgtacccgaaaaggtaacccggaaaccgaaacccggaccccaaaaaggtaaaccgtccaaacgttggtaacttccgtacgaaactaaaagttacggaaaacgtgttaggtagggaacgtaggtaccgggaaggaccgaacggggtcttaggtttaaattacgttttcgtggttacgggacggggagggggtaccgccggggttacttaaggttcggggttaacggacccgtcgggtacggggacccgtaacggggtaccccgttgggtacccc

SEQ ID NO: 337976 - DNA, 684 bp, Homo sapiens
  misc_feature: GZ8MTXP02JNCXF.10.85.H08.1.454.CMB.2.raw
  modified_base (307)..(307): a, c, t, g, unknown or other
  misc_feature (307)..(307): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtcaatgtgaggagcagctggtggagtcgtgggggagccgtggtccgagggcccggggggtccctggagactctcctgtggagcggtaccggattcgactttgattacttagttggatgagcgtcggtccnccgaggcctccggaggggaagggcgtggaggtgggtcgccaaccgaagtaaaggagagtggaagtgaacgtaacgttcgtttggcgggtcttcgtgggtaggaacgggcgtacttacacccgtatcctacgaagacgaacaaacccgacccaaaggtaaacgtccaacgttgtaaactcgtacggaaactaaaagtggaaagtagttaggtagacgtaagggtacggaacggtaccgtaacgggtactagtttaacgtttaagttttcccggaggtacgggaccggtaagggggtacccgtccggtagtttaacgggttcgggttacccgggacccggtttgggaccggggtaacccggacggggtttaaacccccg

SEQ ID NO: 337977 - DNA, 602 bp, Homo sapiens
  misc_feature: GZ8MTXP02F7N7B.10.85.H08.1.454.CMB.2.raw
  modified_base (426)..(426): a, c, t, g, unknown or other
  misc_feature (426)..(426): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtccctgagactctcctgtggagcgtccggattcgacttgatacttattggatgagctgggtccgccaggctccgagggagggctggagtgggtggccaccagtaaaggaagagtggaagtgaagaactactttggtgggctcgtggtaggaagggccgagttcaccatctcccagagaacaacgcaaagaancactgtatctgacaaatgaacgtataggtagaggtacgtacggaaggacgacggtcttagttattacgtttcgtggttacggaggggtacgggggtacgcccggggtacttaacggttacggggtttacccgggtacccgttcgggtacgggggaccctaacgggggtaacccccg

SEQ ID NO: 337978 - DNA, 574 bp, Homo sapiens
  misc_feature: GZ8MTXP02HK7EN.10.85.H08.1.454.CMB.2.raw
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (469)..(469): a, c, t, g, unknown or other
  misc_feature (469)..(469): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggccggggggtcctgagactctcctgtggagcgtccggattcgactttgattacttattggatgagctgggtccgccaggctccgaggggaggggctgggagtggggtcggccacaagtaaaggagatgggaagtgagaacttntttggngggctctgtgagggcattcacatcnccagagacaacgccaaagagtcaactgtatctgaacaaagttgaaacgatagtgagagtcgaggacncgggtactggttaatatttcgtaggtcggacggacgggggcgtcccgggtataacggtggggtttacccgaccgtttggccgggggacctaacgggggtaccccg

SEQ ID NO: 337979 - DNA, 653 bp, Homo sapiens
  misc_feature: GZ8MTXP02J1KO1.10.85.H08.1.454.CMB.2.raw
  modified_base (269)..(269): a, c, t, g, unknown or other
  misc_feature (269)..(269): n is a, c, g, or t
  modified_base (482)..(482): a, c, t, g, unknown or other
  misc_feature (482)..(482): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggagccgtgggtccagggcccggggggtccctgagactctccgtgtggagcgtccggnttcgtacttgattacttatggatgagtcgtgggtccgcgaggctccgaaggggaggggcgtgggaggtgggtcgacccgaaccgtaaagtaaaacggaagagtagggaagtagaagtaacttagtttggtcgggtctgtggtagaacgggcctatttacacctatcctacagaacgacaacgccaaagacgtcacgttgtactctagacaaancgaaagtgtaggtagaggtaacggtcggaaggacctacgggtcttaggttaaactttgtttcggcggtacggggtacggggaaggggtccggtaccgggttgttaaccgggttcggggttacccggacccggttacggggtaccgggggtacccggtaacgggttaccccg

SEQ ID NO: 337980 - DNA, 719 bp, Homo sapiens
  misc_feature: GZ8MTXP02H3SD3.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggaggccgtggtccgagggcccggggggtccctggagacctctcctggtggaggtcgtccggattcgtacttgtatacttattggatgagcgtgggtccgccgaggcgtccgaggggaaggggcgtgggaggtggggtcgaccgaaccgaaagtaaaggaagagtagggaaagtgaagtaacttacgtttggtacgggtcgttcgtaggtacgggaacgggtaccgttactaccaaccgtactccgtacccgaaggaacgaaccgaaacccgaactaaaggtaacgtcacgttgtatctagaaacaaagttagaaacgtagtaggtaggagtaacggtacgggaaacggtacgaccgggttgttaagttacgtttacgtttttcggacgggttggggaaccggggttaaggggggcccgttacccgggtagtttaacgggttaccggggttacccgggaccccggttgggggtacccgggggacccggtaaaacccgggggtccccgg

SEQ ID NO: 337981 - DNA, 708 bp, Homo sapiens
  misc_feature: GZ8MTXP02F6HWJ.10.85.H08.1.454.CMB.2.raw
  modified_base (556)..(556): a, c, t, g, unknown or other
  misc_feature (556)..(556): n is a, c, g, or t
  modified_base (580)..(580): a, c, t, g, unknown or other
  misc_feature (580)..(580): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtccctgagactctcctggtggagcgtccggattcgactttgattacttagttggatgagcgtgggtccgcaggcctcgaggggagggctggagtgggtcgaccacgaagtaaaggaagagtagggaagtgaagtaaacgttacgtttggtcgggtcttcgtggtaggaaacggggtccgtattccacctatcctaccgaagaacgaaccaaacggaccaaaaggtaactccgtaactaggttaactaccgtagaaaccaaaaagttcggaaaacgtgttagggtaaggaaaggtacggtaccggaaaggaacccgaacggggtntttagttaagtttaacgttttcgnggggtttacgggaccggggtaaagggggaccgtccccgggtacgtttaacggttcgggggttaacccgaaccccggttcggggtaccgggggaccccgtaacgggggtaacccccgttgggtaccccg

SEQ ID NO: 337982 - DNA, 682 bp, Homo sapiens
  misc_feature: GZ8MTXP02J2NCR.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgagggccggggggtccctgagctctcctgtggagcgtcggattcgtacttgatacttattggatgagcgtgggtccgcaggcctccgaggggacggggctgggaggtggggtcgacccaacaagtaaaaggaagagtaggaagtcgaacgtaacgttacgtttggcgggtaccttcgtgggtacgggaaacgggggtcccgtaagtttcccgaacctaacttcccgaaacccgaaagggaacgaaacccgaaacggacccaaaaaggacgtaccaacgttgtaactcgttagaacgtaaaagttcggaaaacgtattgggtaggaaacggtagtccggggaaacggaccgacgggtcttaggtactttagtttcggagggtcggacgggtaaggggccgccggtatacggttcgggtccgaccgttcggacggggacccgacggggtacccctggtacccc

SEQ ID NO: 337983 - DNA, 615 bp, Homo sapiens
  misc_feature: GZ8MTXP02ITR3V.10.85.H08.1.454.CMB.2.raw
  modified_base (307)..(307): a, c, t, g, unknown or other
  misc_feature (307)..(307): n is a, c, g, or t
  modified_base (471)..(471): a, c, t, g, unknown or other
  misc_feature (471)..(471): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagcttgggttttccttgttgttattttagaaggtgtcaatgtgaggagcagcgtgggtggagtcgtgggggagccgtggtccgagggccggggggtcctggacgactctccgtggtggagcgtccggattcgactttgattacttagttggatgagcgtgggtcccnccgaggctccggaggggaggggctgggaggtggggtcgcccaacgaagtaaagggaagagtaggaagtgaacgtaacttacgtttggtggtacttcgtgggtagaacggggcccgtattccaactatcctaccgagacgaacaacgaccaaagacgtcatgtanctgacaaatgaaactgtgtagagagtacgagacgacggtntagtattgttcgnggtggacgggagggcgtccggtacgttacggttcggtaaccggccggttcgggtaccggggaccgtaaccggggtacccgttacggtcccg

SEQ ID NO: 337984 - DNA, 618 bp, Homo sapiens
  misc_feature: GZ8MTXP02JNFMN.10.85.H08.1.454.CMB.2.raw
  modified_base (411)..(411): a, c, t, g, unknown or other
  misc_feature (411)..(411): n is a, c, g, or t
  modified_base (528)..(528): a, c, t, g, unknown or other
  misc_feature (528)..(528): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagcgtggtggagtcgtgggggagccgtgggtccgagggcccggggggtccctggagactctccgtggtggacgcggtcggattcgtactttgatacttagttggatggagcgtcgggtccgccgagggccgtaccggaggggaaggggtcgtggggaggtggggtcgaccgaccgaaagtaaaggaagagtagggaaagtgaagtacttacgtttgggnggtctcgtggtaggacgggcgtatccgacatctaccgagacgacaacgacaaggatcgatagtactcgagaataaacgtgacgtagtgtagaaggagtcgggaacgacgaacggttnttaagttattacgttgtagggcggacggggtacggggtacgccggtagttcggttcggtaccggcgtcggacggggaccgtacggtaccg

SEQ ID NO: 337985 - DNA, 526 bp, Homo sapiens
  misc_feature: GZ8MTXP02ILKKD.10.85.H08.1.454.CMB.2.raw
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagcatagtagtgcacgaccggtgctcgatttagtatcactcagtcgcgggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggagcctggtccagccggggggtcctgagactctctgtggagcgtccggattcgatttgatacttattggatgagntggtcgccgaggctccgagggaaggggcgtggaggtgggtggcgaccaataaaggaaagagtaggaagtagagaactaattgtggngtctgtgaggcgattcacatctccagagaacaacgaccaaagaagacatntatntaganaatagaagatagtagagagagagacgacgatagtatattcgtgtgacggaggacggcgtcgtagtcggtcgtcgtcgtcggacggacggaccgtacgtcg

SEQ ID NO: 337986 - DNA, 675 bp, Homo sapiens
  misc_feature: GZ8MTXP02F20DY.10.85.H08.1.454.CMB.2.raw
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctgggtggagtcgtgggggaggccgtgggtccgagggcccgggggggtcctgagactctcctgtggagcgtccggattcgactttgattacttattggatgagctgggtccncaggctccgaggggagggctgggaggtgggtgcccaacgagtaaaggaagatagggaagtgaagtaacttacgtttggngggtctcgtggtaggaacggggcctaatttccaccgtatccctaccgaagaacgaaccaaacgacccaaaggaaacgtcctacgtacgtattaccgtagaactaaaagtcggaaacgtagttagtagaaggaaggttccgggaaagggaccacgggtcttaggttaactttaagttttccggtaggttcggggacggggaagggggacgcccgggttagttaagggtttcggggttacccggtaccgttcggggtacgggggaccccgtaacgggggtaacccccgg

SEQ ID NO: 337987 - DNA, 637 bp, Homo sapiens
  misc_feature: GZ8MTXP02IJUAW.10.85.H08.1.454.CMB.2.raw
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcgtggtttctgttgttatttagagtgtcaatgtgagagcagcgtggtggagtcgtggggagccgtggtccgaaccgggggtcctggagactctctgtgagcgtcgatcgtattgatacttatggatgagcgtggtacccgcgaggcgtccgaaggggaaggggtcgtagggtaggtcgggtacggacccgtaaacgaaggtaaaaaggaagtaagtaggtaaacggtagtaaacgtaacgtttacgtttggtacgggtcttcggtggtaaggaacggtaccgtagttccaactaagtccacgaagacgaacacgaaccgaaagacgtacatagtancgtagaactaagtacgaaagtngtagagtaggtacgaggaccgtaagtcgtagttaatttcgttgtaggtaacggaggggaacgggtcgtaccgggttagtggttaacgggttccgaccggtcgggtacggggacccgtaacggttaccccggtcg

SEQ ID NO: 337988 - DNA, 733 bp, Homo sapiens
  misc_feature: GZ8MTXP02ID6K8.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggccggggggtccctgagactctcctgtggagcgtcggattcgactttgatacttattggatgagcgtgggtccgccaggctccgaggggaaggggctgggaggtgggtggaccaccaagtaaaggaagagtaggaagtgaagtaacttacgtttggtgggtcctcgtggtagggaaacggggcccggtaatttccgaaccctattccacccgaaggaagaacccaaaaccgacccaaaaagggtaacgttaccaacgttaggtaacttaccgttaggaaacctaaaaagttcgggaaaaaccggtgttaacggggtacggaaagggtaacgggttacgggaaacggggtaacccgtaaacgggggtcctttaggggtttaaaacctttagtttttccggtggggttacgggaaccgggggtaggggggaccgtcccgggtagtttaagtttcgggggttacccgggtacccgtggtccggggggaccccaacgggggttaacccccg

SEQ ID NO: 337989 - DNA, 718 bp, Homo sapiens
  misc_feature: GZ8MTXP02IM0CG.10.85.H08.1.454.CMB.2.raw
  modified_base (191)..(191): a, c, t, g, unknown or other
  misc_feature (191)..(191): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggancagctggtggagtcgtgggggaggccgtggtccgagggccggggggtccctgagactctctgtggagcgtcggattcgactttgattacttagttggatggagtcgtgggtcccgccgaggcctaccggaggggaaggggcgtgggaggtggggtcggacccaaccgaaagtaaaaggaagagtagggaagtgaagtaacttacgtttggtggcttcgtggtaggaacggggcctattaccgacctatcctacccgaagaacaccgaaacgaccaaagtaacgtcaacgttgtaactctagactaaaacgtgaaaaccgtagtaggtacgaaggacggttacgggaacgggtaaccgtacggggtactttaaggtttaattttaacgtttttccggaagggttcggggaaaccgggggtaggggggtaaccctccccgggggttagtttaacggtttccgggggttacccggtaacccggtttcggggtacccgggggaacccgttaaaaccgggggtaacccccgg

SEQ ID NO: 337990 - DNA, 657 bp, Homo sapiens
  misc_feature: GZ8MTXP02H5W1V.10.85.H08.1.454.CMB.2.raw
  modified_base (298)..(298): a, c, t, g, unknown or other
  misc_feature (298)..(298): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgaggcccggggggtcctggagactctcctgtggagcgtccggattcgactttgattacttattggatgagttcggccncaggctccgaggggaggctggaggtgggtcggccaacgaaagtaaaggaagagtaggaagtgacgtaacttacgtttggcgggtctgtggtggaaacgggcctaacgttccaacctatcctaccgaagacgaaaccaaaccgaccgaaaagaacgttaccacgttagtaactacgtagaacaaaagtcgaaaacgtgtagtagaaggtacggtacggaacggacctacgggcttaggtaatttacgtttcgtggtacgggacgggaaggggtaccgccgggtacgttacggttcgggttaccggaaccgttccggggtacggggacccgtaacgggtaccccgttggacccctacccgg

SEQ ID NO: 337991 - DNA, 588 bp, Homo sapiens
  misc_feature: GZ8MTXP02JAXV9.10.85.H08.1.454.CMB.2.raw
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (548)..(548): a, c, t, g, unknown or other
  misc_feature (548)..(548): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtccaatgtgaggagcagctggtggagtcgtgggggaggcctgggtccagggccggggggtccctggagactctcctgtggagcgtccggattcgacttgatacttatggatgagcgtgggtccgccaggctccgaggggaaggggcgtagggaggtggggtcggccaaccgaagtaaaggaagagtggaagtgagtaactcgtttaggtgggtctagtggtaggaacgggccgtaattaccacatttcccgacgaagaacgaccaacgaccaaagaatccgatgtatcgagacaaagtgaacgattgagagacggtacggaggaacncgnttagtactttagttcgtggtgacgggaaggggcgtccgtntaaggttcggtaccgacgtggacgggaccgaggtaccccg

SEQ ID NO: 337992 - DNA, 620 bp, Homo sapiens
  misc_feature: GZ8MTXP02F4OEA.10.85.H08.1.454.CMB.2.raw
  modified_base (213)..(213): a, c, t, g, unknown or other
  misc_feature (213)..(213): n is a, c, g, or t
  modified_base (620)..(620): a, c, t, g, unknown or other
  misc_feature (620)..(620): n is a, c, g, or t
tcagcatagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgngggctctgtgaagggccgattcaccatctccagagacaacgccaagaagtcactgtatctgacaaatgaacgatgtgagagtcgaggacacggctgtattatttcgtggtggcggaggggacgcccgggtcttagtcgggttccggaccttccggtcgggggccccaaggggaacccccttggtacccaccgttctcaattccaccgcccctaccgaccgaacgggccctacgtccggtcccttcccccgtggcccgtcccctcgcctcccgaggaccgccacccgtccgacgacgccgaccgtacggccggcccgtgggcctcgccgtgtaccgaacggtacctaccttacccactacgtactcggactcggcggccgggcgtcggacgaacggcgacgacgacgn

SEQ ID NO: 337993 - DNA, 657 bp, Homo sapiens
  misc_feature: GZ8MTXP02H2PKZ.10.85.H08.1.454.CMB.2.raw
  modified_base (385)..(385): a, c, t, g, unknown or other
  misc_feature (385)..(385): n is a, c, g, or t
  modified_base (466)..(466): a, c, t, g, unknown or other
  misc_feature (466)..(466): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctggttttccttgttgttattttagagtgtccaatgtgagagcagctggtggagtcgtgggggaggccgtggtccgaggcccgggggggtccctggacgtacgtcgtcccgtggtggagccgtccggattcgactttgatacttattggatgagctggtccgccaggctccgaggggaagggctggagtgggtgaccacaagtaaaggagagtggaagtgaagaacttacgtttggngggtcttcgtgtggaacggggcctagttccaccctagtccctacgagacgaaccaacgaccaaagaacgtcacgtgtaacnctagacaaaagttgaaacgtagtggtagaaggaggttaccggaagggaccgtacgggtcttaaggtttattaaacgtttttccgtaggtacgggaccgggaaagggggtaccgcccggggtacttaaggtccggggtttaccgggaccccttggggtacccgggggacccgtaaccgggggtaaacccccg

SEQ ID NO: 337994 - DNA, 594 bp, Homo sapiens
  misc_feature: GZ8MTXP02GP202.10.85.H08.1.454.CMB.2.raw
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (562)..(562): a, c, t, g, unknown or other
  misc_feature (562)..(562): n is a, c, g, or t
tcagcatagtagtgcacgaccggtgctcgattttagtatcactcagtcgcgggggagggtctcagagaggagccttagccctggactccaaggcctctccacttggtgatcagcactgagcacagaggactcaccatggaattggggctgagcttgggttttccttgttgtttattttagaaggtgtccaatgtgaggagcagctggtggagtcgtgggggaggccgtggtccgaggccgggggggtccctgagctctctggtggagcgtcggattcgtacttgatcttagttgatgagngtgggccncaggcctcgaggggagggcgtgggaggtggggtcgaccacgaagtaaaaggagagtaggaagtgaagtaacttcgttgtggggctcgtgtagacgggctatcaacntcncagacacacncaaagancattcgtatctagactaaatagaacgtatggtaggaaagtgaaccgggagaagccgggtattagtaactttntttcggngttacggcggggaaacgggggcgtaccggcgttaggttacggggttccnccggtttacggcgggggtaccgaaacccgggg

SEQ ID NO: 337995 - DNA, 619 bp, Homo sapiens
  misc_feature: GZ8MTXP02IS3AR.10.85.H08.1.454.CMB.2.raw
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
  modified_base (531)..(531): a, c, t, g, unknown or other
  misc_feature (531)..(531): n is a, c, g, or t
tcagcatagtagtgcacgaccggtgctcgatttagtatcactcagtcgcgggggaggtctcagagaggagccttagccctggactccaaggcctctccacttggtgatcagcactgagcacagaggactcaccatggaattggggctgagctgggttttccttgttgttattttagaaggtgtccaatgtgaggagcagcgtggtggagtcgtgggggacgcctggtccaggccggggggtccctgagctctctgtgagcgtcggattcgatttgatacttattggatgagcgtgggtccncgaggcctccgaggggagggctggagtggggtcgccacgagaaaggagagtgggaatgaagtacttacgtttgnggggtacttcgtggtagtaacggggccgtatttaccaccgtatcctacccgaagacgaacaaaccgcccaaaagagtaccaacttgtaaacgttcctaggaacctaaaagttacggaaacgagtaggtagacggtagtaccggaggaaccacggtnttagtattattcgtggtacggacgggtaggggacgtcggtaagttacggtcgggttaccggtaccgtcgggaccggggaccgtacggg

SEQ ID NO: 337996 - DNA, 724 bp, Homo sapiens
  misc_feature: GZ8MTXP02GUNZX.10.85.H08.1.454.CMB.2.raw
  modified_base (310)..(310): a, c, t, g, unknown or other
  misc_feature (310)..(310): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgagggccggggggtccctgacgctctctggtggagcggtccggattcgtactttgattacttagttggatgagtcgtcggggtcccnccgaggccgtaccggaaggggaacggggcgtgggaggttcggggtcggacccaaaccgaaagtaaaacgggaagagtacgggaagtgaaagtaaccgttacgtttggtgggtccttcggttggtaggaacggggtccctagtttaccaccgtatcctaccgaagaacgaacaaccgaccgaaagtaacgtcctaacgtgttacgtatacggaaactaaagtacgaaacgagttaaggtgaaaggtacggacgggaaacggaccgtacggggtacttacgggttaacttttaggtttcgtggtacggggtacgggaacgggggtaccgtcccggggtaattaacgggttccggggttacccgggtaacccgttaccggggttccgggggaacccggtaaccgggggttacccccg

SEQ ID NO: 337997 - DNA, 778 bp, Homo sapiens
  misc_feature: GZ8MTXP02JPVE4.10.85.H08.1.454.CMB.2.raw
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagcgtgggttttccttgttgttattttagaaggtgtccaatgtgaggagcagcgtggtggagtcgtgggggaggccgtgggtccgagggcccggggggtccctggacgactcctccgtggtggagtccggtccggattcgacttgattacttatggatgagtcgtcgggtccgcgaggccgtaccggaaggggaggggcgtgggagggtcggggtcggacccaacgtaaagtaaaagggaagagtaggaaagtgaagtacttagttggtggggtctcggtaggtacgggaacggggaccttacgttacccgaacctacgttcccgtaccgaaaggaaccgtaaacccgaaaccggacccgaaaaggtaaaccgtcctaacgttacgttaataccgtacggtaaaacaaaagttacggaaaacggttagttaagggtacgggtaaagggaaacgggttacccggaaaggggtaaaacccgtccgggttaacgtttagggtttaaacctttaggtttttccggagggttacggggacgggggtaacgggggtcgtaccccgggttaaggtttacggttcccgggggtacggtaaccccggttcggggtaccgggggacccgtaaacccggggg

SEQ ID NO: 337998 - DNA, 595 bp, Homo sapiens
  misc_feature: GZ8MTXP02HF1JP.10.85.H08.1.454.CMB.2.raw
  modified_base (409)..(409): a, c, t, g, unknown or other
  misc_feature (409)..(409): n is a, c, g, or t
  modified_base (477)..(477): a, c, t, g, unknown or other
  misc_feature (477)..(477): n is a, c, g, or t
  modified_base (518)..(518): a, c, t, g, unknown or other
  misc_feature (518)..(518): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttccttgttgttattttagaaggtgtcaatgtgaggagcagctggtggagtcggtgggggaggccgtgggtccgagggcccgggggggtccctggacgtactcgtccgtggtggagcggtccggattcgactttgatacttagttggatgagcgtgggtccgccgaggctccggaaggggaaggggcgtgggaggtggggtcgacccgaacgaaagtaaaaggaagagtagggaaagtgaagtaacttagtttggngggctgtggtagaacgggctatcacatcacagacgacaacgacaaagaacgtcactagtactcgtaanaacaaagtagaagtagtagagagagacggaacgacgacgtntagttacttagttcgngnggacggacgggcgcggtatggtcggtaccggacgtcgggccggggacccggtacgtcgg

SEQ ID NO: 337999 - DNA, 712 bp, Homo sapiens
  misc_feature: GZ8MTXP02HZ6WW.10.85.H08.1.454.CMB.2.raw
  modified_base (388)..(388): a, c, t, g, unknown or other
  misc_feature (388)..(388): n is a, c, g, or t
tcagcatagtagtgcacgaccggtgctcgatttagtatcactcagtcgcggggagagaggagccttaaccctggactccaaggtctctccacttggtgatcagcactgagcacagaggactcaccatggaattggggctgagctgggttttccttgttgttattttagaaggtgtcaatgtgaggagcagctggtggagtcgtgggggagcctggtccgaggccgggggtccctgagactctctgtggagcgtcggattcgtacttgtatacttattgatgagcgtcggtccgccgaggcgtccgagggagggcgtaggaggtggtggaccgacaagtaaaggaagaagtaggaagtagaagtaacgtacgtttaggtgggtcgtcgnggtttttttttttgggaacgggtaccgtacgttacctaaccgtactacctaccgaacgaacgaaaccaaaccgaaccgaaaacgaaacgtacgtaccgttagttaacgtacgttacgaactaaaacgtaacggtaaacgtaagttagtaggtaagggacggtacggaacggaacggaacggtacgttagttaagttagtttacgttcggtaggtacgggacggggtaacgggccggtacgttaacgttacgggttccgggtaacccggttcggtaccggggtacccggtaaccgggtaacccggttacggttaccgtaccccgg

SEQ ID NO: 338000 - DNA, 732 bp, Homo sapiens
  misc_feature: GZ8MTXP02JH61V.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctggttttccttgttgttatttagaaggtgtccaatgtgaggagcagctggtggagtcggtgggggaggccgtgggtccgacgggcccggggggtccctggacgaccgtcctcctggtggacgcgtccggtattcgtacttgattacttgtggatgagtcgtgggtccgccgaggcctccggaaggggaacggggtcgtggggaggtggggtcggcccgaaaccgaaagtaaaagggaaaggagtacggggaagtacggaacgtaaacgtttacgtttaggcggggtcttcgtagggtacgggaacggggtccgtaacttaccaccgtaactccgtaccaaggaccgaaacgaaccgacccaaaaggaacgttcctaacgtagtacttacgtagtaaccaaaagttcggaaactaggtacggtagaaggacgtacggggaacgtaacgaccggtgttagtttaaacgtttcgtttcgtgggtaacgggccggggtagggggtaacccgtcccggggtatttaacgggtcggggtttacccgacccgggttcggttaccgggggacccgttaacgggggttaaccccg

SEQ ID NO: 338001 - DNA, 679 bp, Homo sapiens
  misc_feature: GZ8MTXP02HWGBJ.10.85.H08.1.454.CMB.2.raw
  modified_base (180)..(180): a, c, t, g, unknown or other
  misc_feature (180)..(180): n is a, c, g, or t
  modified_base (315)..(315): a, c, t, g, unknown or other
  misc_feature (315)..(315): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtntcaatgtgaggagcagctggtggagtcgtgggggagccgtggtccgacgggcccggggggtccctggacgactcgtccgtggtggacgtcgtccggattcgactttgattacttagttggatgagctcgggtccnccgaggcctccggaaggggaaggggcgtggggaggtgggtcgccgaaccgagtaaaaggagagtacgggaagtggaagtaaacgttacgtttgggagggtctcgttggtaggggtaacggggccgtatttaccgaccctagttcctaccgagaacgaaccgaaacgacccgaaagaactcgacttgtactccgtagacctaaaagtgaaacgtatggtagaaggaggtacggagggaccgagggtccttaagttattaagttttccgtaggttcgggaccgggtaaggggcggtccggtacggttaagtcggggttaccggtacccgttcgggtccgggggtacccgacgggggttaacccccg

SEQ ID NO: 338002 - DNA, 755 bp, Homo sapiens
  misc_feature: GZ8MTXP02IXU4O.10.85.H08.1.454.CMB.2.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (645)..(645): a, c, t, g, unknown or other
  misc_feature (645)..(645): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggaggtcggggngggcgtcggtcggacggccgggggtcccgggtcgngacgtctcgtcgtggacgcgtccggacgttcgtacgttcgtagtacttagttaggtagtagtaggcggtcggtccggcccgacggcggtcccgtaggggaacgggggtacggtcgggtagggtggggtcgggaccgaaccgaaacgtaaaaggaaaggaaggtaggtaaggtaggtagaacgttaacgtttggttagggcgttcgtcggtaggaacggggtaccgtaccgtactaaccgacttacgtcccgaaaggaagaaacccgaaacgacccgaaaagtaaacgtaccgtaacttaacggttataccgttaaggaccctaaaagttacggaaacgtagtagttaaggagaggtacgaaggggaccgacgttcggtatttagttacgtttcgttggngggtaacggggacggggttacggacccggtcggtttaaagtttccgggggtccgtttaccccggacggggtcggggaacccggaaaccggggtacccctttaaccggggg

SEQ ID NO: 338003 - DNA, 656 bp, Homo sapiens
  misc_feature: GZ8MTXP02I3U8P.10.85.H08.1.454.CMB.2.raw
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgagggcccggggggtcctgagactctctggtggagcgtcgattcgacttgatacttatggatgagcgtggtccgccaggcctaccgaggggaagggcgtagggaggttggggtcgaccgaaccgaagtaaaagggagagtagggaagttaggaagtaaccttacgtttcggtagggtcctggttaggaggaaccggggtcctacgttaccaccgtattcccaacgaaggaacgaaaccaacccgtacaaagtactcgactagtattacgtnaaacgtaanaggaacngttgaacgagacggtcggaaacgcgtaaccgtgtagtttacgtagtttcgcgggttagacgggggacggggtacccgcggttaacgttgggttccggggttaccgaccgttaccggggtcggggacccggtaacggggttaccccg

SEQ ID NO: 338004 - DNA, 704 bp, Homo sapiens
  misc_feature: GZ8MTXP02IGWOM.10.85.H08.1.454.CMB.2.raw
  modified_base (590)..(590): a, c, t, g, unknown or other
  misc_feature (590)..(590): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttatttagaggtgtcaatgtgaggagcagcgtggtggagtcgtgggggaggcccgtgggtccgacgggtccccgggggggtccctggacgtaccttccgtccgtggtggacgtccggtccggtattcgtactttgattacttagttggatgagtcgtgggtcccgccgaggccgtaccggaagggggaacggggtcgtggggagggttcggggtcgacccgaaacgtaagtaaaagggagtagtagggaagtagaaagtaacgttacgtttggtggggtccttcggttgggtaacgggaacggggtaccgtacgtttacccaacccgtattccccgtaaccgaaggaaccgaaacccgaaacccggacctaaaaggtacgtaccaccgttgttaactccgtaagaacctaaagtacgaaacgtntagtaggagtagaccggagacgacggtcttagtatttgttcgtaggacggacgggaggggccgccggtaagtacggttcggtccggaccgtcggtacggggaccgtaacccggg

SEQ ID NO: 338005 - DNA, 695 bp, Homo sapiens
  misc_feature: GZ8MTXP02FQ7KX.10.85.H08.1.454.CMB.2.raw
  modified_base (295)..(295): a, c, t, g, unknown or other
  misc_feature (295)..(295): n is a, c, g, or t
  modified_base (502)..(502): a, c, t, g, unknown or other
  misc_feature (502)..(502): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgagggccggggggtcctgagactctcctgtggagcgtcggattcgactttgatacttattggatgagctgggtccncaggctccgagggaggctggagtgggtgcccacgaagtaaaggaagatgggaaagtgaagtaacttacgtttaggtggggaccttgttcgggtaggaaacgggggcccgtaattccgaaccattccctaccgaagaacgaaccaaaaccggcccaaaaggaaacgtcctaaacgttgtaactcgtagaaacaaaagtcgaaaacgtnttaggtagaagacggtacggaacggaccgtaacgggcttaaggttaactttaagttttcgaggttagggcggggtaaacgggggtacaccccggggttacgttaaggtttcgggggtaaccccggtaacccgttcggggttaccgggggaccccgtaaaccggggttaaacccccgttcgggttaaacccccg

SEQ ID NO: 338006 - DNA, 624 bp, Homo sapiens
  misc_feature: GZ8MTXP02F70UH.10.85.H08.1.454.CMB.2.raw
  modified_base (332)..(332): a, c, t, g, unknown or other
  misc_feature (332)..(332): n is a, c, g, or t
  modified_base (549)..(549): a, c, t, g, unknown or other
  misc_feature (549)..(549): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtgggtccgagggcccggggggtccctgagactctcctgtggagcgtcggattcgactttgatacttattggatgagcgtggtccgccaggctccgagggagggctggagtgggngccacgagtaaaggagagtggaagtgaagtaacttacgtttggtgggcttcgtggtagggaacggggtcccgtaatttccgaaccctagttccctacccgaaggaacgaaccaaaccgacccaaaaggtacgtacacgtgtaatcgtagactaaaagtgaaacgtagtggtagaggtacgtacggaaagggacacggggtcttagtacttatttcgnggtggacgggtaggggaccgccggtataacggtcgggttcggaccctgggacggggtcccgaacggggtaccccg

SEQ ID NO: 338007 - DNA, 633 bp, Homo sapiens
  misc_feature: GZ8MTXP02FG80A.10.85.H08.1.454.CMB.2.raw
  modified_base (573)..(573): a, c, t, g, unknown or other
  misc_feature (573)..(573): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccgagggcccgggggggtcctgagactctcctgtggagcgtcggattcgatttgatcttattggatgagcgtgggtccgccgagggcctccggaggggaaggggctggggaggtggggtcggacccaaccaagtaaaagggaagagtagggaaagtggaagtaaacttacgttttggtggggccttcgtggtaggaaacgggggccctaattccgaaccattcctacccgaagacgaacccaaacggcccaaaagaacgtcctaactgtaatcgtgaaccaaatggaaacgagtgtaggaagcgtacggaaggacacggctagtattagtttcgtggtggcggaacgggggtcncccgggtatggttcggggtcgaccgtcggtacgggggcctaaggggacccctggtacccc

SEQ ID NO: 338008 - DNA, 586 bp, Homo sapiens
  misc_feature: GZ8MTXP02H3WWZ.10.85.H08.1.454.CMB.2.raw
  modified_base (239)..(239): a, c, t, g, unknown or other
  misc_feature (239)..(239): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (515)..(515): a, c, t, g, unknown or other
  misc_feature (515)..(515): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccgaggccggggggtcccngagactctcctgtggagcgtcggattcgactttgatacttattggatgagtctgggtccgccaggctcgaggggaagggctggngngggtggccacgaagtaaggaagataggaagtgagtaacttactttagtgggctcgttggtaggaagggtcccgagtttccaccgtactctacccgagacgaacaaccgaccgaagaatcccatagtatactagacaaaatcgaacgtagtagtagagagtacggaagggtacaggcttagtatatttcgngtggacgggtaggggcgcccggtataagtcgggttacggacccttcggtcggggaccgacggggtaacccg

SEQ ID NO: 338009 - DNA, 844 bp, Homo sapiens
  misc_feature: GZ8MTXP02G1A1O.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccgagggcccggggggtccctggagacctcgtccgtggtggacgtcggtccggtattcgtactttgattacttagtggatggagtcgtcgggtacccgccgtaggcctaccggaaggggtaacggggtcgtggggaggttcggggtcggacccaaccgaaagtaaaaggggaaagtagtaggggaaagtaggaacgtaaacctttacgtttagggtgggtccgttgttaggtacgggaaacgggtcccgtattaccgaaccctagttccctacccgaagaacgaacccgaaaacccggaccctaaaaaggtaacgttccctaaaaccgtttggtaactttaacccgagtaaaacccgtaaaaagttacgggaaaacccggttagttagggtaaacggaaggtaaacgggttccggggaaaacgggaaccgtaacccggggttcttaaaggtttaaacgtttaacgtttttcccgggagggtttaccggggaacccgggggttagggggaaacccggtccgggggttaaccgtttaaaggggtttcccgggggtttacccgggtacccgttcgggggttacccgggggaaacccccggtaaaacgggggtaaccccccgg

SEQ ID NO: 338010 - DNA, 711 bp, Homo sapiens
  misc_feature: GZ8MTXP02ITUNP.10.85.H08.1.454.CMB.2.raw
  modified_base (203)..(203): a, c, t, g, unknown or other
  misc_feature (203)..(203): n is a, c, g, or t
  modified_base (595)..(595): a, c, t, g, unknown or other
  misc_feature (595)..(595): n is a, c, g, or t
  modified_base (638)..(638): a, c, t, g, unknown or other
  misc_feature (638)..(638): n is a, c, g, or t
tcagcatagtagtgcacgaccggtgctcgatttagtatcactcagtcgcggggagagaggagccttagccctggactccaaggccctctccacttggtgatcagcactgagcacagaggactcaccatggaattgggctgagctgggttttccttgttgttatttagaaggtgtccaatgtgaggagcagctggtggagtcgngggggacgcctgggtccgacgggcccgggggggtccctggacgtactctccgtggtggagccggtccggattcgacctttgattacttatggatgagcgtggtccgccagggcctaccggaggggaaggggctgggaggtggggcggtacccgaaccgtaagtaaaagggaagtagtaggggaaaggtacgaaagtaaccgtttacgtttgggtgggtaccttcgtggggttaggaaacgggggccctagtttacccgacctacgttaccacccgagaaacgacccgaaaccggaaccaaagtaaacggtcctaaccgttagttaactccgtagaaacctaaagttagaaaccgtagttaggacggagtacggacggaggaccgtaacggtnttaggttaattaccgtttcgtaggttggacggaagggggtacnccggggtaacttggttcgggttaaccggtaccgtccggggacggaccgtaaccggggaccgttaccggtcccg

SEQ ID NO: 338011 - DNA, 854 bp, Homo sapiens
  misc_feature: GZ8MTXP02GE08R.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccgagggcccggggggtccctggagactctccgtggtggagcggtccggattcgactttgatacttagtggatgagcgtgggtcccgcgaggctccggaggggaggggctgggaggtggggtcgaccaacgaagtaaaggaagagtaggaagtgaagtaacttacgtttggtcggggtcttcgtagggtacgggaaacggggtcccgtaatttacccgaaccctattccctaccgaaaggtaacgaaacccaaacccgtacccgaaaaggtaaacgttcccaaacgtttggtaaacttccgtacggaaactaaaaagttcggaaaaacggttgtttacgggtaacgggaaacgggtagggttaaccgggaaaacgggggtaacccgtaaaccgggggtttacgttttaacggttttaaaacgtttttacggtttttaccggggtagggggtttaacccgggggaaaccggggggttaaacggggggttaccccgggttacccgggggtttaaccgggtttaaacgggggttttcccggggggttttaaccccggggtaacccccgggttttcggggggtaacccccggggggtaacccccggttaaacccggggggtttaaaccccccgg

SEQ ID NO: 338012 - DNA, 674 bp, Homo sapiens
  misc_feature: GZ8MTXP02HVPDH.10.85.H08.1.454.CMB.2.raw
tcagcatagtagtgcacgaccggtgctcgattttagtatcactcagtcgcggggctcagagaggagccttagccctggactccaaggcctctccacttggtgatcagcactgagcacagaggactcaccatggaattgggctgagctgggttttccttgttgttattttagaagtgtcaatgtgaggagcagcgtggtggagtcgtgggggagcctggtccgacggccgggggtcctggagactctcgtgtggacgcgtccgattcgactttgattacgttattggatgagcgtcgggtccgcgacggtcgtaccggaaggggaacgggtcgtagggaggtcggggtacgaccgaacgaaagtaaaaggaagaggtaggaagtagaacgtaacgtttgtttaggcgggtcttcgtggtagggaacggtacctagttaccaacctattccacgaaagacgaaccaaaccgacgaaaggtacgtctaacgttgtaacacgttacgaaactaaagttacgaagtgtaggtacggagtaggtacggaaggacgtacgtgttagttaaagttgttttcgaggggttacggtacgggacggggttaccgacggtacgttaacggttccggggtaaccggtccggtacggtacccgggggacgttaaacccggggttcccg

SEQ ID NO: 338013 - DNA, 562 bp, Homo sapiens
  misc_feature: GZ8MTXP02FG83S.10.85.H08.1.454.CMB.2.raw
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
  modified_base (423)..(423): a, c, t, g, unknown or other
  misc_feature (423)..(423): n is a, c, g, or t
  modified_base (457)..(457): a, c, t, g, unknown or other
  misc_feature (457)..(457): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtcccgaggccggggggtccctgagactctcctgtggagcgtcgattcgacttgatactattggatgagctgggtccnccagggctccgaggggaaggggctggagtgggtggcccacaagtaaaggagatggaatgagtactacgtttgngggactcgtgtaggaaggggccgattccacatctaccagagaacaacgccaaagaancactgtatactgacaaatgaacgatgagagtagnggaggacgacggctagttatatttcgtagtggacggagggggacgccgggtactagtcgggttaaccgacgtcgtcgggggaccacggggaacccgtggtacccg

SEQ ID NO: 338014 - DNA, 578 bp, Homo sapiens
  misc_feature: GZ8MTXP02FHYLD.10.85.H08.1.454.CMB.2.raw
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagcatagtagtgcacgaccggtgctcgatttagtatcactcagtcgcggggagagaggagccttagccctggactccaaggcctctccacttggtgatcagcactgagcacagaggactcaccatggaattggggctgagcgtgggttttccttgttgttattttagaaggtgtccaatgtgaggagcagctggtggagtcgtgggggaggccgtggtcccaggcccgggggggttccctggagacctctcctgtggagcgtccggattcgacttgatacttatggatgagctgggtccgcaggctccgaggggaaggggctggagtggggtggcccaaccgagtaaaaggaagagtggaagtgagaactactttgngggtcncgtgtgaaagggtccgattcacatctccagagaccaacgaccaaagaacgtcaacttgtatctagacaaaagttgaaacgntagtagagagcggacgacgacgntagtattattcgtggtgcgggacggggacgccgtacgtagtcgggtccgtaccgtcggtcggggacccgtaacggggacctcggtaccg

SEQ ID NO: 338015 - DNA, 705 bp, Homo sapiens
  misc_feature: GZ8MTXP02FFYVR.10.85.H08.1.454.CMB.2.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (497)..(497): a, c, t, g, unknown or other
  misc_feature (497)..(497): n is a, c, g, or t
tcagcatagtagtgcacgaccggtgctcgatttagtatcactcagtcgcggggagagaggagccttagccctggactccaaggtctctccacttggtgatcagcactgagcacagaggactcaccatggaattgggctgagctgggttttccttgttgttattttagaaggtgtccaatgtgaggagcagctggtggagtcgtgggggaggcctggtccgagggcccggggggtccctgagactctcctgnggagcgtcggattcgatttgattacttatggatgagcgtgggtccncaggctcgagggagggctggagtgggtggcccacgagtaaaaggagagtgggaagtgagtaactatttggtggggcttcgtggtaggaacgggggccgtactttaccacctattccgtacccaaagaacggaaccaaaaccgaccctaaaagggaactccaacttaggttataccctaaaacctaaaaattcgggaaaanagtttagggtaggtaaagggtagtacccggaaaggggaaccctaaccggggtcttaggttaaatttttagtttccggttaggttcgggaccggggtaaggggggtaccgccccggggtacttacgttcgggggtttaccccgaacccgttttggggaccggggggaccccaacgggggtaaaccccctcggggttacccctaacccgg

SEQ ID NO: 338016 - DNA, 745 bp, Homo sapiens
  misc_feature: GZ8MTXP02FGV96.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattgggctgagctgggttttccttgttgttattttagaaggtgtccaatgtgaggagcagctggtggagtcgtgggggagcctgggtccgagggccggggggtccctggagtctctcgtgtggagcgtcggattcgtacttgatacttatggatgagcgtcggtccgcgaggctccgaggggaaggggctggaggtgggtcgaccacgaagtaaaacggagagtaggaagtcgtaagtaactacgtttgggcggcttcgtggtacggaaacggggtacctacttaccaacctaacttccgtaacccgaaagaaacgaaacccgtaaaaccggacccaaaaagggtttaaccacctaaacgtttcggtaactaccgttaggaaacctaaaagtacgggtaaaccgaagtttaggtaacgggaaggtaaccggttacggaaacgggtaaccgcggggtacttaaggtttaatttacgttttcgtagggtacggggcgggtaaaagggggcgtccccggggtaaacttagggtttccgggggtaaaccccgtaccgtttccggggtaccgggggacccccgtaaaacgggggtaaccccccgtttggggtaacccccg

SEQ ID NO: 338017 - DNA, 668 bp, Homo sapiens
  misc_feature: GZ8MTXP02GY2IC.10.85.H08.1.454.CMB.2.raw
  modified_base (312)..(312): a, c, t, g, unknown or other
  misc_feature (312)..(312): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagccgtggtccgagggcccggggggtccctggacgactcgtcctggtggagcggtccggattcgtactttgatacttatggatgagcgtgggtccncgaggctccgaggggaggggtctgggaggtggggtcggcccaacgtaagtaaaaggagagtagggaagtagaagtacttagttggcgggtctcggtaggtacggaacgggggtcctagttccaaccgtatcccgtacgaaggacgaacccgaaacgacccaaagtacgtacctactgtaactccgtagaacttaaacgtagaaaccgtgtaggtaggaaggacggtacggaacggtacgtacggtcttaggtttaaacttcgttttggcgggttacggacgggggtacgggaccgtcgggtaactacgggttcggggttaccgccggtcgggtacgggggacccgtaacccggggg

SEQ ID NO: 338018 - DNA, 709 bp, Homo sapiens
  misc_feature: GZ8MTXP02FF8KW.10.85.H08.1.454.CMB.2.raw
tcagcatagtagtgcacgaccggtgctcgatttagtatcactcagtcgcggggctcagagaggagccttagccctggactccaaggcctctccacttggtgatcagcactgagcacagaggactcaccatggaattggggctgagcttgggttttcttgttgttatttagaaggtgtccaatgtgaggagcagctggtggagtcgtgggggagcctggtccgagggccggggggtcctgagactctcgtgtggagcgtcggattcgactttgatacttagttggatgagtcgtcgggtccgccgaggcctaccggaggggaaggggcgtggggaggtcggggtacggacccgaaaccgtaaagtaaaagggaaagtagtaggggaaagtaggaaagtaacgttacgtttggcggggtctcgtggtaggaaacgggccgtaattccaacgtatcctacccaaggaacgaaccgaacgaccaaaagtacgtacagtagtatcgagaacaaagtacgaaacgtagtaggtacgaaggacgtacggaacgggtaaccacggggtacttaggttaaactttacgttttccggtaggtacggggtaaccgggggaaagggggtacccgtcccggggttaaattaacggggttccgggtttacccggacccgttccgggggtaaccgggggaccccgtaacgggggtaaacccccg

SEQ ID NO: 338019 - DNA, 644 bp, Homo sapiens
  misc_feature: GZ8MTXP02HZDW2.10.85.H08.1.454.CMB.2.raw
  modified_base (275)..(275): a, c, t, g, unknown or other
  misc_feature (275)..(275): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggacggccgtgggccgagggcccgggggggtccctggacgtacgtctccgtggtggagcgtcggnttcgacttgatacttagttggatggagtcgtcgggtccgccgagggtcctaccggaggggaaggggtcgtggggaggtcggggtcgacccgaaaccgaagtaaaagggaagagtagggaaagtgaacgtaacttacgtttggtgggtcttcgtggtacggaacgggtccgtagtccaccgattccgtaccaagacgaccaaacgaccaaagaacgtcaatgtactacgtagaactaaagtagaaacgtgtcgagagagtcggacgacgaggtctagtacttatttcggagtgggacggtaacgggggctccggtacttaaggttcgggtaccgaccggttcggtaccggggacctaaccggggtacccg

SEQ ID NO: 338020 - DNA, 801 bp, Homo sapiens
  misc_feature: GZ8MTXP02IHKSX.10.85.H08.1.454.CMB.2.raw
  modified_base (312)..(312): a, c, t, g, unknown or other
  misc_feature (312)..(312): n is a, c, g, or t
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagctgggttttccttgttgttattttagaagtgtccaatgtgaggagcagctggtggagtcgtgggggaggccgtgggtccgaggcccggggggtccctggagacctctccgtggtggagcgtcggattcgtacttgatacttatttggatgagctgggtccgccnggcctccgaggggaagggcgtgggaggttggggcggccaccaaagtaaaagggaaagagtagggaaagtggaagtaacttaacgttttggtgggtcttcgttaggttacgggaaacggggtcccgtaatttccgaaccctagttacccgtccaaaggacgaaaacccgaaacccgacccgtaaaaacggggtaaaactccctaaaacgggtttacgttaactttccccggtaaagtaaacccgtaaaaaacggtttaggaaaaaccgggttagttaggggttaacggaaaggggttacggggtacgggaaaacggggaacccgtaccgggggttaacctttgggtttaaaaaccttttcggtttttcgtaggtttaacggggccgggggaagggggtaaccggtcccggtaagtttaacgggttaaccggggtttccggaacccggtttcgggtacccgggggtaaccgtaaccgggggtaacccccgg

SEQ ID NO: 338021 - DNA, 741 bp, Homo sapiens
  misc_feature: GZ8MTXP02I7ALE.10.85.H08.1.454.CMB.2.raw
tcagcatagtagtgcacgaccggtgctcgatttagtatcactcagtcgcggggagagaggagccttagccctggactccaaggcctctccacttggtgatcagcactgagcacagaggactcaccatggaattgggctgagctgggttttccttgttgttatttagaaggtgtcaatgtgaggagcagcgtggtggagtcgtgggggaggccgtggtccgacgggccgggggggtccctggacgactctccgtggtggagccgtccggattcgtactttgatacttattggatggagtcgtgggtcccgcgaggctccggagggaggctggagtgggtcgcccacaagtaaaggaagagtaggaagtgaagtaacgttacgtttggtcgggtcttcgtgggtacgaacgggggtccctagttaccaacctacttccgtaacccgaaggtaaacgaaaccccgaaccggacccgtaaaaagtaaacgggtaccctaacgttacggttaacttccgtaacgtaaacgtaaaacgtaaacgggtaaaacgtaagttaggttaacggaaaggtacgggtacggaacggaaaccggtacgggtactttaggttaatttaacgtttcgtcggttacggccggggaagggggtaacggtccgggtaccgttaagggtcggggttaacccggaccggtttaccgggtccggggacccggtacgggtaaacccccggttggtaacccccg

SEQ ID NO: 338022 - DNA, 664 bp, Homo sapiens
  misc_feature: GZ8MTXP02IA7I3.10.85.H08.1.454.CMB.2.raw
  modified_base (494)..(494): a, c, t, g, unknown or other
  misc_feature (494)..(494): n is a, c, g, or t
tcagcatagtagtgcacgaccggtgctcgatttagtatcactcagtcgcggggaggtctcagagaggagccttagccctggactccaaggcctctccacttggtgatcagcactgagcacagaggactcacatggaattggggctgagctgggttttccttgttgttattttagaaggtgtccaatgtgaggagcagctggtggagtcgtgggggagccgtggtccgagggccggggggtccctggacgactctccgtggtggacgcggtccggattcgactttgatacttatggatgagcgtggccgccaggctcgaggggaggcgtggaggtgggtcgccaaccgaagtaaaaggaagtacgtagggaaagtggaacgtaacgttacgtttgggcgggtctacgtggtggaaacggggccaattccaaacgtactcctccgaaagaacggaaaccaaaccggtacaaaataacggttaccactggttaaacncgtagaactaaaagtagaaacgtgtacggtagaacggaggtacggaaggaccgacgggtcttaggttactttacgttcgtaggtacgggacgggacggggacgggaccgggtcgttacggttacgggttaccgggtaccggtaccgggtaccggggtaccgggaccgggg

SEQ ID NO: 338023 - DNA, 816 bp, Homo sapiens
  misc_feature: GZ8MTXP02JDR1D.10.85.H08.1.454.CMB.2.raw
  modified_base (262)..(262): a, c, t, g, unknown or other
  misc_feature (262)..(262): n is a, c, g, or t
tcagcatagtagtgcacgaccggtgctcgatttagtatcactcagtcgcggggctcagagaggagccttagccctggactccaaggcctctccacttggtgatcagcactgagcacagagactcaccatggaattgggctgagcttggttttccttgttgttatttagaaggtgtccaatgtgaggagcagcgtggtggagtcggtggggcgccgtggtccgaggcccgggggtcctgacgactctcgtgtggagcgtccgnttcgattgatactagttgactgagtccgtggtaccctccgacggtcctaccggaaggggtaacggggtccgttaggggtacgggtacgggggtacggacccctaaacccggtaaaagttaaaacggggaaagtaaggttacggggaaaaggttcggtaaacgtaaacctttacggtttgggtcgggtcgttaccgtagggttaacgggaaaccgggttccgaactttcgaaccctaactctaccgaacgacgaaaccacggtaaccaacggtaagtaccaacgttagtacttaccgtacgaaacgttaaaacgaggtaaaccgtagttaccgggaaggttaacggaaacccgggttagggaaacgggaaaacccggtccgggtacgttaaagggtttaaatttaacccgttttttcgggagggtttaccgggtaaccgggggaacgggggttaccggacccggtaacgttaacggggttaccggggttaccgggtaaaccccggtcggggtttacccgggggaacccggtaaacccggggtttaaacccccggg

SEQ ID NO: 338024 - DNA, 792 bp, Homo sapiens
  misc_feature: GZ8MTXP02JH8UP.10.85.H08.1.454.CMB.2.raw
  modified_base (269)..(269): a, c, t, g, unknown or other
  misc_feature (269)..(269): n is a, c, g, or t
tcagcatagtagtgcacgaccggtgctcgatttagtatcactcagtcgcggggctcagagaggagccttagccctggactccaaggcctctccacttggtgatcagcactgagcacagaggactcaccatggaattgggctgagctgggttttccttgttgttatttagaaggtgtcaatgtgaggagcagctggtggagtcgtgggggaggccgtgggtccgagggtccggggggtccctggacgactctcctggtggagcgtccggnttcgacttgatacttatggatgagcgtgggtccgccgaggcctccgaaggggaaggggcgtggggaggtggggtcgacccgaaccgaagtaaaaggaagtagtagggaaagtaggaagtaaacgtttacgtttagggtacggggtccttacggttgggtaacggggtaaacgggggtccgttaacgtttacccgaacccgtaacttccgtaacccgaaggaaacgaaacccgaaccggaacccgtaaaagggtaaaccggttcctaacggttagttaacttaccgtacggaaacgtaaaaagttcgggaaaaccgtgttaaggacggaaaggtaacgggtaaccgggaagggaaacccgtacgggtcttaggttaaactttacgttttccggtagggttacggggaaccgggggttaacgggggaccggtcccgggttacgttaacggggttaccggggttacccggtaaacccggtttcgggggaccgggggtaaaccccggtacggggtttaaacccccgg

SEQ ID NO: 338025 - DNA, 741 bp, Homo sapiens
  misc_feature: GZ8MTXP02FN2XJ.10.85.H08.1.454.CMB.2.raw
tcagcatagtagtgcacgaccggtgctcgatttagtatcactcagtcgcggggggtctcagagaggagccttagccctggactccaaggcctctccacttggtgatcagcactgagcacagaggactcaccatggaattggggctgagcttgggttttccttgttgttattttagaaggtgtccaatgtgaggagcagcgtgggtggaggttcggtaggggggacggcccgttgggtcccgacgggggtccccgggggggttcccctggacgtaccttccgtccgttggtgggacggtccggttcccggtagtttccggtaacgttttgaattactttagttggattgaggtccgttcgggtcccgcctacgggccgtccggaaggggaacggggctgggaggttggggtcggaccgaaccaaagtaaaaggaagagtacggaagtagaaagtaacgttacgtttggcgggtcttcgtggtaggaaccggggtcgtactttaccgacacttcgtaccgagaacgaacgaaccgaaccaaaggtaactcattacgtattcgaagaactaaaagtacgaaacggtagttaggagagtaggaccggaaagggacctaccgggatttaggtaactttgtttacgtgggtaggacggggaacggggtccggtcggttaacgttcgggtttcggggttaccggtacccggttcgggtaccggggaacccggtaacgggtaaccccgg

SEQ ID NO: 338026 - DNA, 519 bp, Homo sapiens
  misc_feature: GZ8MTXP01C5VHJ.9.28.C06.1.454.CMB.2.raw
  modified_base (362)..(362): a, c, t, g, unknown or other
  misc_feature (362)..(362): n is a, c, g, or t
  modified_base (480)..(480): a, c, t, g, unknown or other
  misc_feature (480)..(480): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggctgcattcgttattggaatgatgataaacgctacagcccatctctgaggaccaggctcacccattacagacacctaccaaaacngtgtctacatgacaacatggaccctgtgacacagccacatatactgtgcacacagtgtcatgactgcgtgctgttctcccctttggctcgttggggccagggtaacccctgggttccnccggttctcctcaacgccctccaccaacgggccctaacg

SEQ ID NO: 338027 - DNA, 622 bp, Homo sapiens
  misc_feature: GZ8MTXP01BMNTL.9.28.C06.1.454.CMB.2.raw
  modified_base (485)..(485): a, c, t, g, unknown or other
  misc_feature (485)..(485): n is a, c, g, or t
tcagtgatacgtctcacgaccggtgctcgatttagagctcacgtattggggtttgggggactcctgtgccccaccatggacacactttgctccacgctcctgctgctgaccatcccttcatgggtcttgtccagatcaccttgaaggagtctggtcctacgctggtacgaaacccacacacgaccctcacgctgacctgctaccttctctggttctcactcacactaagtggagtgggtgtgggctggactccgtcactaccccgaggaacggcccgtggaagtggtcttgtctatttcgtttagttaggtaatgatagaataaacgctaacacgaccatctcgtagacggaccaggctaccaaccctactaacgaacgaccaacctaaacccaaaaccgtcggtacgtaccttaacaactacgaacaacacgtacgaccctgacgacacacgaccatattactactgtacacaacacgtaggtntcaagtcgacgtggcgttacgtcgttcgttcccttcccggttggaacgttacgggttcgggaccgttacgggtaacccgtgttcccgttcgttcctccgcaaccgtcccaccgaaccggtaaccggccctaacccgg

SEQ ID NO: 338028 - DNA, 562 bp, Homo sapiens
  misc_feature: GZ8MTXP01BN10W.9.28.C06.1.454.CMB.2.raw
  modified_base (367)..(367): a, c, t, g, unknown or other
  misc_feature (367)..(367): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactcccccaggaaacggccctggaatggcttgcattcgttatggaatgatgataaacgctacagcccatctctgaggaccaggctcacccattacaaggacacctaaccaaaacnggtgtaccttacaatgaccaaacatggaccctggtcggacacagccacatattactgtgacaaccacgagtgtccatgactgcggtgactgttcctcccctttgggccttacggttcgggggacccttaggggaaccccttgggccgcccggttcctccctcaacgccctccgacccgtaacgggccctaaccgg

SEQ ID NO: 338029 - DNA, 553 bp, Homo sapiens
  misc_feature: GZ8MTXP01CJZ0X.9.28.C06.1.454.CMB.2.raw
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccaggaaaggccctggaatggcttgctattcgtttatggaatgatgataaacgctacagcccatctctgagacaggctcacccatacagacacctaaccaaacngtgtaccttanaatgaccaacatcgaccctggtcggacacacgccaacatacttactgtgacacacgagtgtcatgactggacggtgactgttcctccccgttggcctacggttcgggggacccacggggtaacccctggttccgccgttcctcctcaacgcccctaccacccgtaacgggcccctaaccgg

SEQ ID NO: 338030 - DNA, 506 bp, Homo sapiens
  misc_feature: GZ8MTXP01CWDQI.9.28.C06.1.454.CMB.2.raw
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (477)..(477): a, c, t, g, unknown or other
  misc_feature (477)..(477): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctgggttctcactcaccactaatggagtgggtgtgggctggatccgtcatccccaggaaaggccctggaatggcttgcattcgtttatggatgatgataaacgctacagcccatctcngagaccagctcacccatacagacactaacaaacngtgtctanatnacacatcgacctgnggacacagcacatatacngtncacacagtgtcatgactgcgtgactgtcctcccgttgctacgttgggccagggaccctgggccttcccgctccncaacgcctaccgaccaacgggccctaacg

SEQ ID NO: 338031 - DNA, 627 bp, Homo sapiens
  misc_feature: GZ8MTXP01BXZ6M.9.28.C06.1.454.CMB.2.raw
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
  modified_base (438)..(438): a, c, t, g, unknown or other
  misc_feature (438)..(438): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggttctcactcacactaatggagtgggtgtgggctggatccgtcactccccaggaaacgccctggaanggcttgctattcgtttattggaatgatgaataaacgctacagcccatctctgagaccagctcacccatacaacgacaccctaaaccaaaaccnggtacgtaccttaacaatacgaaccaacactacggaccctaggtcggacacgacaccaactataattacgngtacacacacgtagttcgtacagtcgacgtcggtcggtacgtccgttccgtttcccgttcccgtttcggtaaccgtaccgggttccgggggtacccggaccgggtaaccccgttcggttccccgttcccggttccctccctccgtaacccgtccccgtacccgacccggtaacccggttccccgtaacg

SEQ ID NO: 338032 - DNA, 534 bp, Homo sapiens
  misc_feature: GZ8MTXP01CLM8B.9.28.C06.1.454.CMB.2.raw
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
  modified_base (500)..(500): a, c, t, g, unknown or other
  misc_feature (500)..(500): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactcccccaggaaaggccctggaanggcttgcattcgtttattggaatgatgataaacgctacagcccatctctgagaccaggctcacccatacaagacacctaaccaaaacngtgtactacatgacacatgaccctgtgacacagaccacatatactgtgacacacagtgtacatgacctgcggtgactgttctccccgtttggctacgttcgggggccacggggtaaccctggttccgccgttccnccttcaacgccctcgacctaacgggccctaaccg

SEQ ID NO: 338033 - DNA, 635 bp, Homo sapiens
  misc_feature: GZ8MTXP01CCLCG.9.28.C06.1.454.CMB.2.raw
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (432)..(432): a, c, t, g, unknown or other
  misc_feature (432)..(432): n is a, c, g, or t
  modified_base (591)..(591): a, c, t, g, unknown or other
  misc_feature (591)..(591): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactcccccgaggaaaggccctggaatggtctgctagtttcgtttagtaggtatagatagtaactaacgactacgacnccatctcgtgacgacgagcncaccatacgagacaccaaacaaacgngtcgtactanactcgacanacgtacgactgacgacacgtacaccatatactcgtgtnaccaacacggtagtactactagtacgtacgtcggtacgggttactccgtttcggtttccccttcccggtttcggtaaccgttaaccggggttccgggggcccgttaaaccggggtaacccgtcggttaaccccgttcccggtttccctaacccggtacncccgttccccgaccccgaacggtaaccccgggaaccttccccgg

SEQ ID NO: 338034 - DNA, 681 bp, Homo sapiens
  misc_feature: GZ8MTXP01DQIQZ.9.28.C06.1.454.CMB.2.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
  modified_base (448)..(448): a, c, t, g, unknown or other
  misc_feature (448)..(448): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgcaccttctctggttctcactcacactaanggagtgggtgtgggctggatccgtcactccccgaggaacggcctaggaanggcttgctattcgtttatggaatggatgaataaacgctacacgcctatctcgtgaggaccaggcctccaaccctaacttaaccgaaacggaacctaaccctaaaacccaaaaaccgcggtacgtaccttaacaactacgaaccaacatcgggacctaggcgacacacaccanagttatacgtgacacacgacgagtgtaccagtggacctggcggttacgtccctttcggtttaccccttcccgttttgggcccttaacgggttccggggggtaaccccgttaaacgggggttaaaccccccgttcgggggttaaaccccttcccccgggttccttccccgtaacgccccggttacccccaccccgaacccgggttaaacccggggccccccgtttaacccgggg

SEQ ID NO: 338035 - DNA, 668 bp, Homo sapiens
  misc_feature: GZ8MTXP01COU29.9.28.C06.1.454.CMB.2.raw
  modified_base (280)..(280): a, c, t, g, unknown or other
  misc_feature (280)..(280): n is a, c, g, or t
  modified_base (374)..(374): a, c, t, g, unknown or other
  misc_feature (374)..(374): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtagaaacccacacacgaccctcacgctgacctgcctaccttctctggttctcactcacactaatggagtgggtgtgggctggctccgtcactccccgaggaaacggccctggaanggctgctattcgtttatggatgatgataaacgctacacgccatctctgagaccagctcaccccactaacaacgacaaccctaaaccaaaaccgnggtacggtaccttaacaaactacgaaccaacacgtcgaccctggtacgaacacacgaccaactattaacttacgtgtacgactacaccgtagttacgtaccagtgtacgtcggacggttacgtacgtttccgttttccctccccgttttgggaacccttaacgggttccgggggtacccgaaccggggtaaaccccgttcgggttaccccgttaacccggttcccgttcccctaccgccggttacccccgttacccgaaccccggtaaaccggggttccccctttaaccccggg

SEQ ID NO: 338036 - DNA, 682 bp, Homo sapiens
  misc_feature: GZ8MTXP01CVJL9.9.28.C06.1.454.CMB.2.raw
  modified_base (377)..(377): a, c, t, g, unknown or other
  misc_feature (377)..(377): n is a, c, g, or t
  modified_base (471)..(471): a, c, t, g, unknown or other
  misc_feature (471)..(471): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccaggaacggccctggaatggcttgctattcgtttatggaatgatgaataaacgctacagcccatctctgagaccaggctcacccacttacaacggacaaccctaaacccaaaaaaccgnggtacgtacccgttaaacaactacgaacccaaacactacggaccctaggtacgggaacacgaacgcctaacaattaacttacgtcgtagaccanaaccgtaggtcgttaccattggtaacgtcggcgggttacgtaacgttccggtttcccgtaccccgttttcgggccgttaaccgggttcgggggtacccgaacgggggtaaccccgttcgggttcccgttaaccccgggttccctttcccggtaccctaacgttcccccgtaccccgaacccgggaaacccgggttccccgtttaacccggg

SEQ ID NO: 338037 - DNA, 546 bp, Homo sapiens
  misc_feature: GZ8MTXP01CD5EG.9.28.C06.1.454.CMB.2.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (364)..(364): a, c, t, g, unknown or other
  misc_feature (364)..(364): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgctaccttctctggttctcactcaccactaatggagtggtgtgggctggatccgtcactccccaggaagcctggaangntgctattcgttatggaatgatgaataacgctacagcccatctctgagaccaggctacaacccatacaagaccaacctaaaccaaaaccnggtacgtaccttaacaactagaaccaacatcgaccctgacgacacagacactatattacngtanacacacgtagtntacatgactgcgtgtactcgttcctcccgtttgcgttacgcgggtaccagggtaaccctgttaccgccgttcctaacccncnccncctaccaccgtaaccgcctcg

SEQ ID NO: 338038 - DNA, 631 bp, Homo sapiens
  misc_feature: GZ8MTXP01AKG1M.9.28.C06.1.454.CMB.2.raw
  modified_base (278)..(278): a, c, t, g, unknown or other
  misc_feature (278)..(278): n is a, c, g, or t
  modified_base (453)..(453): a, c, t, g, unknown or other
  misc_feature (453)..(453): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggttctcactcacactaagtggagtgggtgtgggctggatccgtcactccccaggaacggcccgtgganggctgctattcgtttagtggaatgatagaataacgctacacgccatctcgtgacgaccaggctcacccactaacgaacgaccaaccctaaacccaaaaccgtggtacggtaccttaacaactacgaaccaacgactacggaccctaggtacggacacacgaccaatatacttacngtacacacacgtagtcgtacagtcgacgtggtacggttactcgtttcgtttcccttccccgtttgggccgttacggttccgggggacccgttaacggggtaacccctcgggttacccgttcccgttcctcccgtcgaaccgtcccgtacccgaccggtaacccgggcccttaacccgg

SEQ ID NO: 338039 - DNA, 541 bp, Homo sapiens
  misc_feature: GZ8MTXP01E0I48.9.28.C06.1.454.CMB.2.raw
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccgaggaacggccctggaatggctgcattcgtttatggatgatgataaacgctacagccatctctgagacagctcacccatacagacaccaaccaaacngtgtactacatgacaacatcgacctgngacacagaccatatattacngtnacacacgaggtntcagtcgactggcggtgacttcgttcctccccgttggcctacgttcgggggcccaggggaacccctgggcccttaccggttcctccctcgaacgtccctaccgacccgaacgggcccctaacg

SEQ ID NO: 338040 - DNA, 642 bp, Homo sapiens
  misc_feature: GZ8MTXP01EOG1G.9.28.C06.1.454.CMB.2.raw
  modified_base (478)..(478): a, c, t, g, unknown or other
  misc_feature (478)..(478): n is a, c, g, or t
tcagtgatacgtctcacgaccggtgctcgatttagagctcacgtattgggtttggggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccgaggaacggcctggaatggctgctattcgtttatggaatgatagaataaacgctacacgccatctctacgacggaccaggctacaaccccaacttaaaccgaaacggaacccaaccctaaacccgaaaaaccgaaggttacggtacccttaaacaactacgaaccaaacgtacgtacggacccttggacggaacaacacgaccccaatattacttacngtacacaacacgagttgtcattagacgtggtcggtacgtcttcggtttcccttccccgtttgggtcctacgggttcggggacccttaacggggaccccttgggacccttcccgttcctaacctccaaccgtcccacccgaaccggaaccggttcccgtaaccgg

SEQ ID NO: 338041 - DNA, 685 bp, Homo sapiens
  misc_feature: GZ8MTXP01AIR0O.9.28.C06.1.454.CMB.2.raw
  modified_base (278)..(278): a, c, t, g, unknown or other
  misc_feature (278)..(278): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgccaccttctctggttctcactcaccactaatggagtgggtgtgggctggactccgtcactccccgaggaacggcctggangctgctagttcgttatgatgatgaataacgctacacgcccatctcgtacggacgaccgacggcctaccaacccctaacttaaccgaaacggaaccctaacccgtaaaacccaaaaaacccgtgggttaccggttaacccttaaacgaactacgaaccaaacgacgtacgtacccttaggacggaaccacaacgacccaactaattacgttacgtcgtacgacctaacacgtagttcgtacagtcgacgtggccggttacgaccgtttcgttccccgttcccgtttggcccgttaacgggttccggggacccgaccgggttaacccctcgggttccccgttacccgttccgtccccttcgaacccggtccctaaccccggacccgtaaccgggccccttaaccccggg

SEQ ID NO: 338042 - DNA, 681 bp, Homo sapiens
  misc_feature: GZ8MTXP01APG8I.9.28.C06.1.454.CMB.2.raw
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtagaaacccacacagaccctcacgctgacctgccaccttctctgggttctcactcaccactaagtggagtgggtgtgggctggactccgtcactccccgaggaacggccctggaatggctgactattcgtttatggaatgatagaataaacgctaacacgccatctcgtaggacgtaccgaggctaccaacccctaacttaaccgaaacggaacccaaccctaaaacccaaaaaccgtgggtacgtacccttaaacaaactacgaaccaaacgacgtaccggtacccttaggacggaaccaaccgaacgaccccaaataacttaagttaaccgtgtacgacaaccgtacggtagttcggtaccaagtcgacgtggtacgtcgtacttcgttcccttcccgtttggcccttaacggttcgggggacccttaacggggtaacccgttcggttacccgttcccggttcctcccgtacaacccgtcccctaccgaccgtaaccggttcccgttaacccgg

SEQ ID NO: 338043 - DNA, 704 bp, Homo sapiens
  misc_feature: GZ8MTXP01APFMJ.9.28.C06.1.454.CMB.2.raw
  modified_base (276)..(276): a, c, t, g, unknown or other
  misc_feature (276)..(276): n is a, c, g, or t
  modified_base (388)..(388): a, c, t, g, unknown or other
  misc_feature (388)..(388): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccgaggaacggcctggaanggctgctattcgtttattggaatgatagaataaacgctacacgcccatctcgtagacggaccaggctacaccccaacttaacgaacggaaccaaccctaaacccaaaaccgnggtacggtacctaacaactacgaacaaacagtacgaccctaggacggaaccacgacacccaatattacgttacttgacacaacactagttgtaccaagtcgtacgttcggtacgggtacgtaccgttccggtttacccctttccccggttttggggcccgttaacggggttcggggggacccccgttaaacggggggtaaaccccgtttccgggggttcccttaaccccgggttcccttaaccccgggttccaacccggttccccctacccggttaaaccccggaaacccgggggttccccctttaaccccggggg

SEQ ID NO: 338044 - DNA, 684 bp, Homo sapiens
  misc_feature: GZ8MTXP01B7HLI.9.28.C06.1.454.CMB.2.raw
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgctaccttctcttggttctcactcacactaatggagtgggtgtgggctggactccgtcactccccgaggaacggccctaggatggctgctatttcgtttagttggaatgatagaactaaacgctacacgacccatctcgtgacgaccgaggctaccaacccctaacgttaaccaaacggaacccaaaccctaaaacccaaaacctcgggtacgtaccttaacaactacgaaccaacacgtcgacctggacgacacacgaccaactattactacgtgtacgacaacacgtagtcgtacctagtacgtacgtcggtcgggtacgtacgtttccgtttcccgttccccgtttgggtcccttaccgggttccgggggtacccgttaaccggggtaaacccgttccggggttacccttcccggttcccttccccgtacgaacccgttacccccgacccgaacccgggtaacccgggttcccgtttaaccccggg

SEQ ID NO: 338045 - DNA, 720 bp, Homo sapiens
  misc_feature: GZ8MTXP01A5VH9.9.28.C06.1.454.CMB.2.raw
  modified_base (278)..(278): a, c, t, g, unknown or other
  misc_feature (278)..(278): n is a, c, g, or t
  modified_base (496)..(496): a, c, t, g, unknown or other
  misc_feature (496)..(496): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgctaccttctctggttctcactcaccactaagtggagtgggtgtgggctggactccgtcactccccgaggaacgccagganggctgctattcgttataggatgatagaactaacgctacacgccctatcctcgtaggacggaccaggcctacaacccctacttaaccgaaacggaccctaacccgtaaaacccgaaaaccgtggtacggttaacccttaaacgaacgtacgaacccaaacgtacgtccgggtaacccttaggacggaacaacgaacgaccctaataattaacttaccgngtacaacaccgaacgtaggtacgtactacgtcgaaccgtcggtcgggttacttacccgtttccgtttaccccgtttccccggttggaacccggtttacgggacccgggggaccgttaaacccggggtaaccccgtttcggttaccccgttacccggttccttaaccccgaccgtaacccggtcccctacccggaacccggtaaccgggttcccccttaaccggg

SEQ ID NO: 338046 - DNA, 570 bp, Homo sapiens
  misc_feature: GZ8MTXP01CFFD0.9.28.C06.1.454.CMB.2.raw
  modified_base (276)..(276): a, c, t, g, unknown or other
  misc_feature (276)..(276): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccaggaaaggccctggaanggctgctattcgtttatggaatgatgataaacgctacagcccatctctgaggacaggctcacccatacaagacacctaaccaaaacngtgtacctanatagacaacactgaccctgcggacancgacacatatacntcganacacgagtgtcattgacctggcgtgtacttcgttcctccccgttttggaaccttacgggttcgggggacccgttacggggtaaacccttcggttacccgacccgttcgtcccctagaaccgtcctacccgaccgtaaccggcccgtaacccgg

SEQ ID NO: 338047 - DNA, 621 bp, Homo sapiens
  misc_feature: GZ8MTXP01CVWDK.9.28.C06.1.454.CMB.2.raw
  modified_base (278)..(278): a, c, t, g, unknown or other
  misc_feature (278)..(278): n is a, c, g, or t
  modified_base (380)..(380): a, c, t, g, unknown or other
  misc_feature (380)..(380): n is a, c, g, or t
  modified_base (593)..(593): a, c, t, g, unknown or other
  misc_feature (593)..(593): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaaccactaatggagtgggtgtgggctggatccgtcactccccgaggaaacggcctggaanggcttgctattcgtttatggaatgatgataaacgctacagccatctctgagaccaggctcaaccccacttacaaaggtaccaaccctaaacccaaaaaaccngggtacgtaccttaaacaaacgtacgaaccaaacacgtacgaaccctggtacgacgaaccagaccaactataacgtttacagtcacaccaaggagttagtcagtagtaaccgtgacggttcgtacttcggttccctcccgtttcggcgttaacggttcggggaccgttacgggtaaccgtacggttccgttaccgttccctccacgtaacccnccctaccgacccgtaaccgaaccgtccg

SEQ ID NO: 338048 - DNA, 598 bp, Homo sapiens
  misc_feature: GZ8MTXP01ACRL1.9.28.C06.1.454.CMB.2.raw
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (492)..(493): a, c, t, g, unknown or other
  misc_feature (492)..(493): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtacgaaacccacacagaccctcacgctgacctgcctaccttctcgtcggttctcactcaaccataagtggaggtgggtgtgggctggactccgtcactacccccgaaggaaacggcccgtaggaagtcggtcttcggtcttagttttcgtttagttaggtaatgaattagaaactaaacgactacacgacccctatctcgtacgacgtacgacgctacaacccaactacgaacgaccaacctaaaaccaaaaccgcgtacgtaccttaanaactacgaacaacagtccggaaccctgacgacacganacccttanaattntaaccgnnacacagatgtanagtgngcgtcgtcgtctcctccgtccgtcgtcgtcgcggcgacgtaccgtcgttcgccttcctcncnccgccaccgaccgtaaccgccgtccg

SEQ ID NO: 338049 - DNA, 537 bp, Homo sapiens
  misc_feature: GZ8MTXP02IC0QD.9.28.C06.1.454.CMB.2.raw
  modified_base (370)..(370): a, c, t, g, unknown or other
  misc_feature (370)..(370): n is a, c, g, or t
  modified_base (456)..(456): a, c, t, g, unknown or other
  misc_feature (456)..(456): n is a, c, g, or t
tcagtgatacgtctcacgaccggtgctcgatttagagctcacgtattgggtttggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctgggttctcactcaccactaatggagtgggtgtgggctggatccgtcactccccaggaaaggccctggaatggcttgctattcgtttattggaatgatgataaacgctacagcccatctctgaggaccaggctcaccccattaccaaggacacctaccaaaaccnggtacggtacctacaatgaaccaaacatacgaccctgtcgacacagccacatattactgtgacacacagtgtacatgactgcggtnacttgttcctccctttggctacgtggggccagggaccctggtccaccgtctcctcacgccctaccaccgaacggccctacg

SEQ ID NO: 338050 - DNA, 511 bp, Homo sapiens
  misc_feature: GZ8MTXP02GAN8S.9.28.C06.1.454.CMB.2.raw
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
tcagtgatacgtctcacgaccggtgctcgatttagagctcacgtattgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatccccaggaagccctggaatggcttgcattcgttattggaatgatgataaacgctacagcccatctctgaggaccaggctcaccccattaccaaggacacctaccaaaacnggtgtccttacaatgaccaacatggaccctgtgacacagccacatattacngtgcacacagtgtcatgactgcggtgactgttctcccttgctactggggccagggaccctggtcaccgtctcctcacgcctccacaacggccctacg

SEQ ID NO: 338051 - DNA, 569 bp, Homo sapiens
  misc_feature: GZ8MTXP02JCL6W.9.28.C06.1.454.CMB.2.raw
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccaggaaaggccctggaatggctgcattcgtttattggaatgatgataaacgctacagcccatctctgaggaccaggctcacccataccaacggacacctaccaaaaccnggtcgtaccttacaatgaaccaacatcggaccctggtacgacacagcacataattacngtcacacacagtcgtacagtgaacgtggcggtggacttggttcctccccgttggcgttacgtgggggacccacgggaaccctcgggtacctacccgtctccccgtcaaccggtccctacccgaaccgaacggggccccctacgg

SEQ ID NO: 338052 - DNA, 552 bp, Homo sapiens
  misc_feature: GZ8MTXP02JBR7X.9.28.C06.1.454.CMB.2.raw
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatccccagaagcctgatgctgcattcgttatggaatgatgataaacgctacagcccatctctgagacaggctcacccattaccaagacacctaccaaaaccnggtgtccttacaatgacaacatggaccctgngacacagccacatattacngnacacagagtntacagtagactggcggtgtacgttcgttcccgttcccgtttaggtccgtacggtcggggaccgtaacgggtacccgtcggtaccctaccgtcctccgtccacgtacccgtacccgtaccgaaccggacccgtaccg

SEQ ID NO: 338053 - DNA, 513 bp, Homo sapiens
  misc_feature: GZ8MTXP02G8N9K.9.28.C06.1.454.CMB.2.raw
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (484)..(484): a, c, t, g, unknown or other
  misc_feature (484)..(484): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactcccccaggaaacggccctggaatggcttgctattcgttatggaatgatgataaacgctacagccatctctgaggaccaggctcacccataccaagacacctaccaaaacnggtcgtacttacaatgaacaacatgacctgngacanagcacatatacngtgcacacagtgcatgactgcgtgactgttcctcccttggctacgtgggccaggacctcggtccaccgtcncctcacgccctaccgaccgacggcctacg

SEQ ID NO: 338054 - DNA, 524 bp, Homo sapiens
  misc_feature: GZ8MTXP02IX7TI.9.28.C06.1.454.CMB.2.raw
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (505)..(505): a, c, t, g, unknown or other
  misc_feature (505)..(505): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggtctcactcaccactaatggagtgggtgtgggctggatccgtcactcccccgaggaaacggccctggaatggcttgctattcgttatggaatgatagataaacgctaanacgcccatctctgacgaccagctcacccataccaagacacacaaaacngtgtactacatgaacaanatacgaccctggtgacacacgaccacatatacagtnacacacagtntanananacgngcgtcgtctcgttcctccgttcgtcgtcgtcggcggacggtaccgtcgtcgtccgtctccgcacnccaccaccgacgaccgtcg

SEQ ID NO: 338055 - DNA, 724 bp, Homo sapiens
  misc_feature: GZ8MTXP02H90KO.9.28.C06.1.454.CMB.2.raw
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcactccccccaggaaaggccctggaatggtctgctatttcgtttagtagtaatgatagaagtaacgactaacgacgacccacttctcgtacggacggaaccgacggtcctaccaacccctaacgttaaaccgaaacggaaccctaaccctaaaacccgaaaaacccgtagggttaccggttaccttaaacgtaaacgtacgaaacccaaactacgtaccggtacccgtggtacggaccaacgacgacccataacttaacttaccgtgtacgaccaccaacgtacggttactactacgtacgtaacgtggcgggttacgtaccgtttccgtttccccgtttcccgtttcggtacccgttacggggttccggggacccgtaaccggggtacccgttacggaccccgtaccggttccctcccgtccgaaacccggtccctacccgaaccccggaaaccggtccccgttaaccccgg

SEQ ID NO: 338056 - DNA, 590 bp, Homo sapiens
  misc_feature: GZ8MTXP02IY0VH.9.28.C06.1.454.CMB.2.raw
  modified_base (373)..(373): a, c, t, g, unknown or other
  misc_feature (373)..(373): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgccaccttctctggttctcactcaccactaatggagtgggtgtgggctggatccgtcactcccccgaggaaacggccctggaatggcttgcattcgttattggaatgatgaataaacgctacagcccatctctgacggtaccaggctacacccattaccaagaccacctaccaaaacnggtacgtacttacaatcgaacaacatcgaccctgtcggacacagccaacatattacagtagaccacaccagtcgtacactagacgtacgcggttcgtacgttcgtttccgttccccgtttcggtcgtcgtcgggggaccgtaccgggtaaaccgtcggtacctaccggtccttaaccgcccgtacggaccctaccgacccgaacggtcccgtaaccg

SEQ ID NO: 338057 - DNA, 692 bp, Homo sapiens
  misc_feature: GZ8MTXP02GHHTI.9.28.C06.1.454.CMB.2.raw
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtcgaaacccacacagaccctcacgctgacctgcaccttctctgggttctcactcaccactaatggagtgggtgtgggctggntcgtcactccccaggaacgcctggatggcttgctatttcgtttagtggaattgatgataaacgctaacacgcctatctntagacggaccgaggtcctcaacccctaacttaaccgaacggtaccaaccctaaacccgaaaaaccgtacgggttacggttaacccttaaacaaacgtaccgaaaccaaacgacgtaccggtaccctcggtacggaaccaacgacgacccaaatacttaaacgtttaccgtagcgaccaacacgtagttacgtactagttacggaacgttggtcggttacgtacgtttcgtttcccctcccgttttaaacgggccttacggggtcggggtacccgtaaaccgggggtaacccttcggggtaccctcccggttctaacccttacgacccggtccctacccgaccggtaacccggggccttaaccccgg

SEQ ID NO: 338058 - DNA, 526 bp, Homo sapiens
  misc_feature: GZ8MTXP02H1GPV.9.28.C06.1.454.CMB.2.raw
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
tcagtgatacgtctcacgaccggtgctcgatttagagctcacgtattgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtnactccccaggaaaggccctggaatggctgctattcgttattggaatgatagataaacgctaacagacccatctctgagacagctcacccatacagacactaccaaaacngtgtctacatgacacatgaccctgngacacagcctacattagtaactgananacacagtgtanatagagtgcgtcgtcgttcgttccttcccgttcgtcgtacgtcggaccgacggaccgtacgtaccgtaccgtcctccgtcacgaccaccaccgaccgaccgcg

SEQ ID NO: 338059 - DNA, 595 bp, Homo sapiens
  misc_feature: GZ8MTXP02IXBAY.9.28.C06.1.454.CMB.2.raw
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
  modified_base (541)..(541): a, c, t, g, unknown or other
  misc_feature (541)..(541): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagacccctcacgctgacctgcaccttctctgggttctcactcaccactaatggagtgggtgtgggctggatcgtcactccccaggaaggccctggatggcttgctattcgtttatggaatgatgaataaacgctacacgcccatctctgacggaccaggctcacccactaccaacgaccacctaaccaaaaccgngggtcgtaccttaacgaactcgaaccaacactacgaccctgtcgacacgagaccacatatacngtcgacacacagtgcatgaccgtggcggtgtacgttcgtttcccttccccgtttggtacgttaccggttcgggggacccgtacgggggtacccctggggtaccccncccggttctaacccgtcgacgtcccctaccgaaccgtacgggaccccttaccgg

SEQ ID NO: 338060 - DNA, 595 bp, Homo sapiens
  misc_feature: GZ8MTXP02IWUBA.9.28.C06.1.454.CMB.2.raw
  modified_base (367)..(367): a, c, t, g, unknown or other
  misc_feature (367)..(367): n is a, c, g, or t
  modified_base (434)..(434): a, c, t, g, unknown or other
  misc_feature (434)..(434): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggactccgtcactccccgaggaacggccctggaatggctgctattcgttatggaatgatgaataacgctacacgccatctctgaggaccaggctcacccactaccaagaccacctaccaaaacnggtacgtacctacaatcgaaccaacagtacggaccctggtcgaacacagacccaactattacttacngtcgacacacagtgacagttcgactggcggtcgtacttcgttcccttcccgttaggtaccgttacggtcggggtacccgacggggtaacccgttcggtaccctacccggttcctccctccgaccgtaccccgtaccgaacccggtaccgggtccctaccgg

SEQ ID NO: 338061 - DNA, 640 bp, Homo sapiens
  misc_feature: GZ8MTXP02JX6ZS.9.28.C06.1.454.CMB.2.raw
  modified_base (597)..(597): a, c, t, g, unknown or other
  misc_feature (597)..(597): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtggtgggctggatccgtcactccccaggaaacggccctggaatggctgctattcgtttatggatgatgataaacgctacacgcctatctctgacggaccaggctaccaccccacttaaccaaacggaacctaccctaaccaaaaaccgtcggtacggttaccttaacatacgaaccaaactatacggacccttggtacgaacacgacgacccactattaattactgtacgaccaacaccgagttcgtactagttcgtaaccgtggtaccgggttcgtacgttcgtttcccgttcccgtttacggtcgtaaccggtcggggacccgtacgggtaacccgtcggtaccgtaccccgtcttcccnccgtaccacccgttacccgaacccggaacggtcccctaaccgg

SEQ ID NO: 338062 - DNA, 673 bp, Homo sapiens
  misc_feature: GZ8MTXP02HVUTR.9.28.C06.1.454.CMB.2.raw
  modified_base (250)..(250): a, c, t, g, unknown or other
  misc_feature (250)..(250): n is a, c, g, or t
  modified_base (502)..(502): a, c, t, g, unknown or other
  misc_feature (502)..(502): n is a, c, g, or t
  modified_base (521)..(521): a, c, t, g, unknown or other
  misc_feature (521)..(521): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtcgaaacccacacacgaccctcacgctgacctgcctaccttctctgggttctcactcaaccactaagtggaggtgggtggtgggntggatccgcacctcccccgaggaaacggccctggaagtggctgctattcgtttatgaatgatagaataaacgctacacgaccctatctcgtaggacgaccaggacctacaacccctaacttaaccgaaacggaacccctaaacctaaacccgaaaaaaccgtcggtaccggttaacccttaacaaacgtacgaaacccaaactacgtaccggtaccctaggtacgaacacacgaccaactattaattaccgngtacgacacgtatacgttnactagtcgtacgtcggtacgtcgttccgttccgtttccccgttccggttcggtaccgtacggggtccgggaacccggtacgggtcccgtacggtcccctacccgttcctcccgacgacccgtacccgacccgaacccggaccgtacccgtcg

SEQ ID NO: 338063 - DNA, 526 bp, Homo sapiens
  misc_feature: GZ8MTXP02I9YHZ.9.28.C06.1.454.CMB.2.raw
  modified_base (185)..(185): a, c, t, g, unknown or other
  misc_feature (185)..(185): n is a, c, g, or t
  modified_base (309)..(309): a, c, t, g, unknown or other
  misc_feature (309)..(309): n is a, c, g, or t
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (414)..(416): a, c, t, g, unknown or other
  misc_feature (414)..(416): n is a, c, g, or t
  modified_base (436)..(436): a, c, t, g, unknown or other
  misc_feature (436)..(436): n is a, c, g, or t
tcagtgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctnacgctgacctgcaccttctctgggttctcactcaccacgtaatggagtgggtgtgggctggatccgtcactccccaggaaaggccctggaatggctgcattcgttatggaatgatgataaacgntacagcccatctctgaggaccaggctcacccattaccaaggacacctacaaaaaccnggtgccttacaatgacaacaanagcncgtgacacanacacatatatannnacacacgtgtcgatagacgngcgtgtctcgtctccttcgtcgtacgtcggcggacggaccgacgtaccgtaccgtaccgtcctccacgcctaccaccgaacggaccgacg

SEQ ID NO: 338064 - DNA, 644 bp, Homo sapiens
  misc_feature: GZ8MTXP02IH20R.9.28.C06.1.454.CMB.2.raw
tcagtgatacgtctcacgaccggtgctcgatttagagctcacgtattgggtttgggggactcctgtgccccaccatggacacactttgctccacgctcctgctgctgaccatcccttcatgggtcttgtccagatcaccttgaaggagtctggtcctacgctggtgaaacccacacagacccctcacgctgacctgccaccttctctgggttctcactcaccactaatggagtgggtgtgggctggatccgcactccccaggaaacggcccgtaggaagtggcttgctagtttcgtttagttgaatgatagaataaacgactacagccattctcgtagacggaccagctacacccactaccaagaccactaaccaaaactcggtacgttacttaacaactacgaccaaacacgtacgtacccaggtacgacaaccagacccaacctaatttaacttacgtgtacgacctaaccgaactaggttgtaccaagttacgacgtaggcggttacgtacttcgttttccctccccgttttaggcccgtacggtacgggggacccacgggggtaacccctttcgggacccttaccgtcccttaacccgtcgaccgtcccaacccgacccgaaacgggtccccttaaccgg

SEQ ID NO: 338065 - DNA, 684 bp, Homo sapiens
  misc_feature: GZ8MTXP02JDABL.9.28.C06.1.454.CMB.2.raw
  modified_base (176)..(176): a, c, t, g, unknown or other
  misc_feature (176)..(176): n is a, c, g, or t
  modified_base (379)..(379): a, c, t, g, unknown or other
  misc_feature (379)..(379): n is a, c, g, or t
tcagtgatacgtctcacgaccggtgctcgatttagagctcacgtattgggtttgggggactcctgtgccccaccatggacacactttgatccacgctcctgctgctgaccatcccttcatgggtcttgtcccagatcaccttgaaggagtctggtcctacgctggtcgaaacccanacagaccctcacgctgacctgcaccttctctggttctcactcaccactaatggagtgggtgtgggctggactccgtcactccccgaggaaacggcccgtaggaatggcttgctatttcgttatggaatgactgaataacgctacacgcctatctctgacggtaccaggctcaccctactaaccaacgacaacctaccaaaacncgggtcgtaccttaacaactacgaacaacactacgtacccgtgtacgacaacacgccaacaatacttacgcgacgtaccacaacgtacgttgtaccagttacgaacgttcggtcggttacggtacctttccggtttacccgttccccggtttcggtaaccggttacccgggttaccggggggaaccccgtaaacccgggggtaacccccgttcggggttaaacccctaccccggtccctttaacccgcgtacccggtacccctaccccgaacccgaaccccgggggtaccctttaacccccgggg

SEQ ID NO: 338066 - DNA, 552 bp, Homo sapiens
  misc_feature: GZ8MTXP01CKYWA.52.50.E06.1.454.CMB.2.raw
  modified_base (323)..(323): a, c, t, g, unknown or other
  misc_feature (323)..(323): n is a, c, g, or t
  modified_base (378)..(378): a, c, t, g, unknown or other
  misc_feature (378)..(378): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagcgcagtacgacacgaccggtgctcgatttagatctactgacaacacacaagggggtgggtccaggaggcagaactctgggtgtctcaccatggcctggatccctctacttcctccccctcctcactctctgcacaggctctgaggcctcctatgaggtgacacagcccaccctcggtgtcagtgtccccaggacagacggccaggatcacctgctctggagaggcattggacaaaacatatggatattggtaccgcagaagcagccaggccctgtgtggtgatatataaagcgagggagacggccccagggactcccgngagcgatacgtcgtcggcctcgagctacgaagggacaacagtcactatcgactancagtggacgtcgaggacagaagacgagcagactattacngtacatcgngacganagcgagttcgtctgtagtggtggtaagttcgggcgggtaacggaccgtaggcgttcggttacccggttcgttaacgggccaacgccccggaacggttcccgtcccgttcccccgtccggg

SEQ ID NO: 338067 - DNA, 513 bp, Homo sapiens
  misc_feature: GZ8MTXP01DOQUC.52.50.E06.1.454.CMB.2.raw
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (494)..(494): a, c, t, g, unknown or other
  misc_feature (494)..(494): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatattggtacggcagaagccaggccaggcccctgtgttggtgatatataaagacagggagaggcccccagggactccctgagcgatactctcggctcagctcaagggacaacngtcacattgaccatcagtggagtcaggcaagaagacgaggcngactattaactgtacaatctgcggacngcagtggttctctagtgtggtaagttcgggcgggtagggaccgaagcttacggccgttctaaggtcngcccaggctcgccccgtcg

SEQ ID NO: 338068 - DNA, 489 bp, Homo sapiens
  misc_feature: GZ8MTXP01AMIR7.52.50.E06.1.454.CMB.2.raw
  modified_base (354)..(354): a, c, t, g, unknown or other
  misc_feature (354)..(354): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
tcagcgcagtacgacacgaccggtgctcgatttagatctactgacaacacacaaggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatattggtacggcagaagccaggccaggcccctgtgttggtgatatataaagacaggagaggcccccagggatccctgagcgatactctggctcagctcaagggacaacngtcacattgaccatcagtgatccgaggcagaagacgaggctgactatactgtcaatcgtgcggacagcagtggtctcatgtggtaatcggngagggacaagcttgcgttcctaaggcngccaggctcgccccctg

SEQ ID NO: 338069 - DNA, 647 bp, Homo sapiens
  misc_feature: GZ8MTXP01APAT8.52.50.E06.1.454.CMB.2.raw
  modified_base (377)..(377): a, c, t, g, unknown or other
  misc_feature (377)..(377): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctggtgtcagtcgtccccaggacagacggccaggatcacctgctctggagaggcagttggacaaaaacaatatagggaatagttggtaccggcagaagccaggccaggccctgtgttggtgatataataaagacgaggggagacggcccccgagggactcccgtggagcgatactcgtcggcctcagctcgaaagggacaacgngtacaactagttacgaaccataccgaggtagggacgtccgagggacaaggaaacggacggagggactaggaaccttagttaacgtcggtactaaatccgtaggaccggaacgaacgcgtaaggttggttcctagtattcgggttagggttaacgttcgggggacgggtaacgggaacccgaaacggtcgttacgggttacccggttaccgttaagggtcccaacgggaccccgaacgggttccgtaacccggttcccccgttaacccggg

SEQ ID NO: 338070 - DNA, 516 bp, Homo sapiens
  misc_feature: GZ8MTXP01ATJNS.52.50.E06.1.454.CMB.2.raw
  modified_base (362)..(362): a, c, t, g, unknown or other
  misc_feature (362)..(362): n is a, c, g, or t
  modified_base (432)..(432): a, c, t, g, unknown or other
  misc_feature (432)..(432): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagcccaccctcggtgtcagtgtccccaggacagacggccaggatcacctgctctggagaggcattggacaaaacatatggatattggtacgcagaagccagccaggcccctgtgttggtgatatataaagacgagggagacggcccccagggactcccgtgagcgatactctcggctcgagctcgaagggacaacngtacacattgaccatcagtggagtccgaggcagaacgacgagctagactagtactgtacaatctgcgacngcagtgtctcatgtgtgtcggcgggtaggccgtaaagcttacgccgttacgtaaggtcaacgcccaaggcctcgccccgtccgg

SEQ ID NO: 338071 - DNA, 579 bp, Homo sapiens
  misc_feature: GZ8MTXP01EQ6NM.52.50.E06.1.454.CMB.2.raw
  modified_base (262)..(262): a, c, t, g, unknown or other
  misc_feature (262)..(262): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggccaggatcacctgctctggagaggcattggacaaaacaatagtggatagttggtaccgnaagagcaggccacggcctgtgtgtgatatataagacgaggacgacggccccgaggactccgtgacgcgatacgtcgcggcctacgagctacgaacgggacaacgagtacatattcgacatcgagtgacgtacgaggcagaagacgagctagactatacgtgtacagtctaggacgacaggctagggttacggttctacgtagttgggttacggtaaggttccggggacgggtaacggaaccgtacggtcgttacggttacccgttacgtaagggaccgaacgacccgggaacgttccgtcccggccccgttaaccgg

SEQ ID NO: 338072 - DNA, 672 bp, Homo sapiens
  misc_feature: GZ8MTXP01EH5GH.52.50.E06.1.454.CMB.2.raw
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcactgctctggagaggcattggacaaaacatatggatatggtacgcagaacgcaggccaggccctgtgtggtgatatataaagacgaggagacggccccgagggactcccgtgagacgactaactcgtcggcctacgagcctacgaaaggggaccaacgtagtccaactacgtttcgaaccctagttaccgaggttacggacggtccgaacgggaccgaaggaaacggaccggaagggccttagaaccgttaattacgtagtactaaacgttcgttacggaccgggaacacgacgtaacggttacgggtttcctacgtaagttgggttacgggttaagtttacccgggggaggggtaaccgggaaccggtaaacgtccggttacggttcccggttaccggttaacgggtaccaaccggggtacccgaaacggttcccgtcccgggttcccccgtttcccgggg

SEQ ID NO: 338073 - DNA, 780 bp, Homo sapiens
  misc_feature: GZ8MTXP01CEVMU.52.50.E06.1.454.CMB.2.raw
tcagcgcagtacgacacgaccggtgctcgatttagatctactgacaacacacaagggggtgggtccaggaggcagaactctgggtgtctcaccatggcctggatccctctacttctcccctcctcactctctgcacaggctctgaggcctcctatgaggtgacacagccaccctggtgtcagtcgtccccaggacagacgccaggactcactgctcgtaggagaggctagttaggaacaaaaactaatagtaggtaattagttacgggtaccggacgaagaaacggcccgacgggcccgaacgggtccccgttaggttcggttaggtagtaattaaagttaaagtaaaacggaacggaagggggaacggaaccggaccccccggaaggggtaccgtcccgtaggaacggtacgtaacgtacgtacgtccggtacctaccgaggtaccgtaccggaaaacggggaaaccaaccgacggttaaccaacgtacgtttacggaacctagttacggtacggtacggggaacgtacccggaagggacgaaaggaaacgggacggaaggaccgtaggtacttaatttacgtacgttaactacgtacgtcggaccggaacgacgtacgtagggtttacgttcgttacgtaggttggttcggggttaacggttccggggacggggtaacgggaacccgtaaacgggtccgttaccgggttcccgttaccgggttaaggacccgaacccggtacccgacggccccgtaaccggttcccccgttaacccgg

SEQ ID NO: 338074 - DNA, 682 bp, Homo sapiens
  misc_feature: GZ8MTXP01B2SZL.52.50.E06.1.454.CMB.2.raw
  modified_base (296)..(296): a, c, t, g, unknown or other
  misc_feature (296)..(296): n is a, c, g, or t
tcagcgcagtacgacacgaccggtgctcgatttagatctactgacaacacacaagggggtgggtccaggaggcagaactctgggtgtctcaccatggcctggatccctctacttcctccccctcctcactctctgcacaggctctgaggcctcctatgaggtgacacagcccaccctcggtgtcagtcgtccccaggacagaccggccaggatcacctgctcgtggagaggctagtggaacaaaacatagtggatagttggtaccgcagacgccgaggccacggccctgtgtggtnatatataaagacgagggagacggccccgagggactccgtgacgcgactactcgtcggcctcgagcctacgaaacggggaccaacgacgtaccaactacgttacgacctagtacgtaggtagggacggtaccgaagggaccgaagggaaacggacggaacggtacgtacggtaacttaagttaacgtgttaacgtaagtcgtacggaccggaagacggtacgtagggtttacggttcctacgtaaggttcgggttgggttaacgggttccggggacggggtaaacggttaccggtaaacggtccgttaccgggttacccgttaccggtaacggtcccgaaccggaccccgaacgggttcccgtaaccccggttcccccgttaaccgg

SEQ ID NO: 338075 - DNA, 617 bp, Homo sapiens
  misc_feature: GZ8MTXP01BLUO1.52.50.E06.1.454.CMB.2.raw
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccacctcggtgtcagtcgtccccaggacagacggccaggatcacctgctcgtggagaggcagttggacaaaacatatggtatattggtacggnagaagccaggccaggccctgtgtgtnatatataagagagggagacggcccccgagggactcccgtagagcgactactcgtcggctaccgagcctacgaaacgggaacaacgagtccaactattcgacatacgagtggagtccgaggacaaggaacgtacgggaggtacgtacgtaacgttaacttacgtacgttacggtaaacttcgtacggacgggtaaccaggtaccgtaaggttcgggtttacctgtaagtcgggtttagggtaacgttcggggacgggtacggacgtaaacggtcgttacgccggttaccgaacggtgaacgtcccgaagttcccgtccgttccccgttcgg

SEQ ID NO: 338076 - DNA, 671 bp, Homo sapiens
  misc_feature: GZ8MTXP01BOGQM.52.50.E06.1.454.CMB.2.raw
  modified_base (179)..(179): a, c, t, g, unknown or other
  misc_feature (179)..(179): n is a, c, g, or t
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccacctcggtntcagtcgtccccaggacaggacggccaggactcacctgctctggagaggcattggaacaaaacatagtggatagttcggtacgnagaacgccgaggccgacggccctgtcgttggtanatatagtaaagacgagggacgacggccccgagggactcccgtgacgacgatacgtcgtcggcctacgacgctacggaaacgggaaccaacgagtaccactagttacgaccataccgtaggtaggacgtccgaaggaccgaagaaacggacggtaggacgtaggtaacttacgttaacgtacggtacttaaactcgtacggaccggaacgacggtacgtacggtttacggttcctacgtaaggttcggttgggttaacggttccggggttacggggacgggaccgtaaacgggtcttaaccgggttccgttacccggtaaggtacccgaaccggtacccgtacgggttcctccccggttccccgttaaccccggg

SEQ ID NO: 338077 - DNA, 679 bp, Homo sapiens
  misc_feature: GZ8MTXP01D8ZSG.52.50.E06.1.454.CMB.2.raw
tcagcgcagtacgacacgaccggtgctcgatttagatctactgacaacacacaagggggtgggtccaggaggcagaactctgggtgtctcaccatggcctggatctctctacttcctccccctcctcactctctgcacaggctctgaggcctcctatgaggtgacacagccaccctcggtgtcagtcgtcccaggacagacgccagatcacctgctgtggagaggcagttaggaacaaaaacaatataggattagttcggtaccggacaaggaacgccgaggcccgacggtccccgtggttcggttggtagtaattaataaagtaaaacgacgaagggaacgaccgggacccccgagggtacctccgtagacgcgtataccgtccgcggtctaccgacgcgtaaccgaacgggaacaaacgtacgttaacactaacgtacgacctactacgtaggtaggacgtacgaggacgaaaggaacgacgacggactacgtaacttaacgtttaccgtaggttaactaacgttacgtacggaccggaccgtagtaccgttaggttcgttacgtacgttacggttggtaacgttacgggttcggggaacggttacgggaaaccgtacgttacgttcgacccgttcgtacggtcacggacccgacggtccgttcccggtaacccccg

SEQ ID NO: 338078 - DNA, 632 bp, Homo sapiens
  misc_feature: GZ8MTXP01CU50G.52.50.E06.1.454.CMB.2.raw
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggccaggatcacctgctcgtggagaggcattggacaaaacatatggatagttggtaccggcagaagccaggccacggccctggtgttggtagtatataagtaaagacgaggggagacggccccgagggactcccgtgagcgatacgtcgtcggcctcgagcctacgaaacggggacaacgacgtaccactattcgacagtcgaggtggacggtccgaggacgaaggaaacggacggaaggcgtagtaacgttactttaacgtcgttacgtaagtcgttagggaccggactacggcgtacgggtttcggtacttcgtaagttcgggttagggtaacgttcggggacgggtacgggaccgtaaggtcgttccggcccgttacggtcggtaccgaacggacccgtacggttccctcccggttcccccgttccgg

SEQ ID NO: 338079 - DNA, 684 bp, Homo sapiens
  misc_feature: GZ8MTXP01EV3AR.52.50.E06.1.454.CMB.2.raw
tcagcgcagtacgacacgaccggtgctcgatttagatctactgacaacacacaaggggggtgggtccaggaggcagaactctgggtgtctcaccatggcctggatccctctacttctccccctcctcactctctgcacaggctctgaggcctcctatgaggtgacacagccaccctcggtgtcagtcgtccccgaggacagacggccaggatcacctgctcgtggagaggcagttggaacaaaacaatagtggtaatagttagggtaccggcgaaggaacgccgaggcccgacggccccgtggtgttggtagtaatagtaaagtaaagacgagggacgacggccccgaggtactcccgtagacgcgactacgtcgtcggcctacgagtcctacgaaacgggaacaacgtacgtaccaactagttaccgaaccgtataccgtaggtacggacggtaccgaaggacgaaggaaaggaccggaggtccgtaggtaactaacttacgtacgttacgaacgttacggtacggacgggaacgtacgagtagggttaccgttcgtacgtagttggtcggttaacggttcggggaccggggtaacggaaccgtaacggtcgttaccggttaccgttccggtaacggtccgaaccgaccggaacggttccctcccggttaaccccgttcccgg

SEQ ID NO: 338080 - DNA, 556 bp, Homo sapiens
  misc_feature: GZ8MTXP02GHUJ3.52.50.E06.1.454.CMB.2.raw
  modified_base (285)..(285): a, c, t, g, unknown or other
  misc_feature (285)..(285): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatattggtaccgcagaagccaggccaggcccctgtgttgngatatataaagacgagggagacggccccagggactcccgtgagcgatactctggcctccagctcgagggacacgagtcaacattcgaccatcagtggactccgaggcagaagacgaggctgactagttactgtacaatctggcggacagcgagttcggttctcgtagtggtggtacgttcggggacgggacgggaccaaggtccgtacggtacccgttaccgtaagggtccgaacggaccccgaacggtccgtacccggcccccgttccgg

SEQ ID NO: 338081 - DNA, 490 bp, Homo sapiens
  misc_feature: GZ8MTXP02GGZ6C.52.50.E06.1.454.CMB.2.raw
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (434)..(434): a, c, t, g, unknown or other
  misc_feature (434)..(434): n is a, c, g, or t
  modified_base (450)..(450): a, c, t, g, unknown or other
  misc_feature (450)..(450): n is a, c, g, or t
  modified_base (471)..(471): a, c, t, g, unknown or other
  misc_feature (471)..(471): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacatatggatattggtacggnagagccaggccaggcccctgtgttggngatatataaagacaggggagaggcccccagggactcccgtgagcgatactctcggactccagctcagggacacgagtcacattgaccatcagtgatccgagcagaagacgaggctgactattactgacaatctgcggacagcagtcgttncagtgtggtattcggnggacgggacagctcgccgtcngtcagccagctcgccctcg

SEQ ID NO: 338082 - DNA, 519 bp, Homo sapiens
  misc_feature: GZ8MTXP02HXFK4.52.50.E06.1.454.CMB.2.raw
tcagcgcagtacgacacgaccggtgctcgatttagatctactgacaacacacaagggggtgggtccaggaggcagaactctgggtgtctcaccatggcctggatctctctacttctccccctcctcactctctgcacaggctctgaggcctcctatgaggtgacacagccaccctcggtgtcagtgtccccaggacagacggccaggatcacctgctctggagaggcattggacaaaacatatggatattggtaccgcagaagccaggccaggcccctgtgttggtgatatataaagacgagggagaggcccccaggggactcccgtgagcgatactcctgctccagctcgagggcaacagtcacattgaccatcagtggagtcgaggcaagaagacgaggactagactattactgtacaatctggcgacgagcgagtgtctcatgtggtagttcggcggagggaccgaagcgtagacccgtcgtacggtacgacgaccgaacggccgttcgcccccgg

SEQ ID NO: 338083 - DNA, 497 bp, Homo sapiens
  misc_feature: GZ8MTXP02IZHNA.52.50.E06.1.454.CMB.2.raw
  modified_base (360)..(360): a, c, t, g, unknown or other
  misc_feature (360)..(360): n is a, c, g, or t
  modified_base (403)..(403): a, c, t, g, unknown or other
  misc_feature (403)..(403): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatatggatattggtacggcagaagcaggccaggcccctgtgtggtgatatataaagacagggagacggcccccgagggactccctgagcgatactcgcggctccagctcgacggacacgngtacacattcgaaccatcagtgagccaggcaagaagacgagcngactattactgtacattcngcgacagcagtgtctnatgtgtagtcggaggacggacagctcgaccgtcgtaagcacgccgagctcgcccctcgg

SEQ ID NO: 338084 - DNA, 568 bp, Homo sapiens
  misc_feature: GZ8MTXP02FVC9J.52.50.E06.1.454.CMB.2.raw
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatatggatagttggtaccggcagaagccaggccaggcccctgtgttggtgatatataaagacgagggagacggcccccgagggactcccgtgagcgatacgtcgtcggcctccgagctacgaagggacacgagtcaactacttgaccatcagtggacgtcgaaggcaagaagacgaggactagactattactgtacaagtctagacgganaacgcgtagtggttactntagtgtaggtacgttcgggacggtacggacgaacgcgtacggacccgttacgtaacggtaccgacggtacccgaacggtccgtccgcccccgtttaccgg

SEQ ID NO: 338085 - DNA, 579 bp, Homo sapiens
  misc_feature: GZ8MTXP02F753Z.52.50.E06.1.454.CMB.2.raw
  modified_base (284)..(284): a, c, t, g, unknown or other
  misc_feature (284)..(284): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggccaggatcacctgctctggagaggcattggacaaaacatatggatattggtaccgcagagcaggccaggcccctgtgtggngatatataaagacagggagacggccccagggactcccgtgacgcgatactcgtcggctccagcctcgagggacacagtcactatcgacatcagtgagtccagcaagagacgagctgactatactgtacaagtctagacgggacaacggctaaggttggttactcgtagtggtggttacgttcgggacgggtaacgggaacccgtaaaggtccgtacggtacccggttaccgtaacgggttcccgaaacggacccccggaaagggtacccgttacccggaccccccgtttccgggg

SEQ ID NO: 338086 - DNA, 593 bp, Homo sapiens
  misc_feature: GZ8MTXP02H86GJ.52.50.E06.1.454.CMB.2.raw
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
  modified_base (488)..(488): a, c, t, g, unknown or other
  misc_feature (488)..(488): n is a, c, g, or t
tcagcgcagtacgacacgaccggtgctcgatttagatctactgacaacacacaagggggtggtccaggaggcagaactctgggtgtctcaccatggcctggatccctctacttctccccctcctcactctctgcacaggctctgaggcctcctatgaggtgacacagccaccctcggtgtcagtcgtccccaggacagacggccaggatcacctgctctggagaggcattggacaaaacatatggatattggaccggnagagccaggccaggcccctgtgttggngatatagtaaagcgaggggagacggcccccgaggactccctgagcgatacctcgtcggcctccagcctcgaacggggaacaccgagtacaactacttcgaccaattcgagtggacgtacccgagggacaagaacgaccggaagggcctagtaacttagttaaactgtacaaatccgtggacgggaacagctaggttgttaccnaagtggtaggttacgtcgggacgggacggtaacccaagtccgtacggtacccgtaccgtaagggtaccaaccggcccgtaaggcccgttcccggcccccgttcgg

SEQ ID NO: 338087 - DNA, 581 bp, Homo sapiens
  misc_feature: GZ8MTXP02F7J3U.52.50.E06.1.454.CMB.2.raw
  modified_base (259)..(259): a, c, t, g, unknown or other
  misc_feature (259)..(259): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatattggtaccggnagaagcaggccaggccctgtgtgtgatatataaagacgagggagacggcccccgagggactcccgtgacgcgatactctcggctccagctacgagggacacgagtacactatacgaccatcagtggacgtaccgaggcaagaagacgagctagactattactgtacaatcgtgacggacagcgtagttcggttctcgtagtggtacggttaacgttccggggacgggtaaacgggaacccgtaaaggtccgtacggaccccggttaccgtaacggttccgaacggaccccgaagggtcccttacccggcccccgtttaccgg

SEQ ID NO: 338088 - DNA, 582 bp, Homo sapiens
  misc_feature: GZ8MTXP02JEUX0.52.50.E06.1.454.CMB.2.raw
tcagcgcagtacgacacgaccggtgctcgatttagatctactgacaacacacaagggggtgggtccaggaggcagaactctgggtgtctcaccatggcctggatccctctacttcctccccctcctcactctctgcacaggctctgaggcctcctatgaggtgacacagccaccctcggtgtcagtcgtccccaggacagacggccaggatcacctgctcgtggagaggcattggacaaaacatagtggatagttggtaccggcagagccaggccaggccctgtgttgtgatatataaagacgagggagacggccccgagggactcccgtgacgcgatactcgtcggcctccgagcctacgaacggacacgagtccaactagttcgacctatcaggtggacgtaccgaggacaagaacgacggaggactagacttattactgtacaatcgtcgacggactagcgtaggttcgttcacgtagttggtggtacggttcgggacgggacgggtaaccaacggtccgtacggtacccgtcgtaacggtacgacggacccgaacggtcccgtccgtcccccgtccgg

SEQ ID NO: 338089 - DNA, 545 bp, Homo sapiens
  misc_feature: GZ8MTXP02I79YU.52.50.E06.1.454.CMB.2.raw
  modified_base (370)..(370): a, c, t, g, unknown or other
  misc_feature (370)..(370): n is a, c, g, or t
  modified_base (452)..(452): a, c, t, g, unknown or other
  misc_feature (452)..(452): n is a, c, g, or t
tcagcgcagtacgacacgaccggtgctcgatttagatctactgacaacacacaagggggtgggtccaggaggcagaactctgggtgtctcaccatggcctggatccctctacttcctccccctcctcactctctgcacaggctctgaggcctcctatgaggtgacacagccaccctcggtgtcagtcgtccccaggacagacggccaggatcacctgctcgtggagaggcagttggacaaaacaatagtggatattggtaccgcaagagccaggccaggcccctgtgttggtgatatataaagacgagggagacggcccccgagggactcccgtagacgcgatacgtctggcctccagctcgagggacangtcactatcgacatcagtgacgtcaggcaagaagacgagctagactatactgtacatctgacggtacagctaggtcgttacnctagtggtggttaacgttcgggagggacggaaccgaagtcgtacggaccgttacgtaaggtcacgtacccgaacggctccggccccctttcgg

SEQ ID NO: 338090 - DNA, 580 bp, Homo sapiens
  misc_feature: GZ8MTXP02G7YRM.52.50.E06.1.454.CMB.2.raw
  modified_base (216)..(216): a, c, t, g, unknown or other
  misc_feature (216)..(216): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtcccaggacagacgccaggatcacctgctntggagaggcattggacaaaacatatggatattggtaccggcagaagccaggccaggcccctgtgtggtgatatataaagacgaggggagacggcccccgagggactcccgtgagcgatactcncggcctaccgagctcgaagggacaacngtcactattcgacatcagtgagtccaggcaagagacgagctgactattacgtgtacaaatcgtagcgggaacagaccgtaggttcggttctaccagttggtaggttacgttccggggacgggaacgggaacccgaaaggtccgtacggtaccccgtaccgtaagggttccgaacggacccgaaagggccctacccggtccccccgttacccggg

SEQ ID NO: 338091 - DNA, 534 bp, Homo sapiens
  misc_feature: GZ8MTXP02HHCTI.52.50.E06.1.454.CMB.2.raw
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacatatggatagttggtaccggnagaagccaggccaggcccctgtgttggngatatataaaagcgagggagacggcccccgaggggactccccgtaggagccgatactctggcctccagctcgaggacacngtcacattcgacatcaagtggagtcaggnagaagcgngcngacgtataactgtacaatcgtagcggacngacctagtcggttcngtagtgttggtagttcggtcggacgggacgacgacgcgtaccgtcgtaacgtcgacgaccgaacgaccgtcgccccgtcccgg

SEQ ID NO: 338092 - DNA, 525 bp, Homo sapiens
  misc_feature: GZ8MTXP02J2NFX.52.50.E06.1.454.CMB.2.raw
  modified_base (223)..(223): a, c, t, g, unknown or other
  misc_feature (223)..(223): n is a, c, g, or t
  modified_base (305)..(305): a, c, t, g, unknown or other
  misc_feature (305)..(305): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctgganaggcattggcaaaacatatggatattggtaccggcagaagccaggccaggcccctgtgttggtgatatataaagacaggganacggcccccagggtatccctgagcgatactcgtcggctccagctcgagggacacngtcacattgaccatcaagtggacgtaccgaggacaagagacgaggctgacttagtacngtcaanctgcgacgagcgagtggttctcngtgtgtagttcggcggacggacgacgacgtcgtaccgtaccgttaacgtacgacgaccgaacgcgtcgtcccgtcccg

SEQ ID NO: 338093 - DNA, 620 bp, Homo sapiens
  misc_feature: GZ8MTXP02JRAO2.52.50.E06.1.454.CMB.2.raw
  modified_base (296)..(296): a, c, t, g, unknown or other
  misc_feature (296)..(296): n is a, c, g, or t
tcagcgcagtacgacacgaccggtgctcgatttagatctactgacaacacacaagggggtgggtccaggaggcagaactctgggtgtctcaccatggcctggatccctctacttcctccccctcctcactctctgcacaggctctgaggcctcctatgaggtgacacagcccaccctcggtgtcagtcgtccccaggacagacggccaggatcacctgctcgtggagaggcagttggacaaaacatatggattagttggtaccggcagaacgccaggccacggccctgtgttggtnatataagtaaagacgagggagacggacccccgagggactcccgtaggacgacgtactaccgtcgtccggcctaccgacgccgtacgaacggggaaccaccgacgtacaacgtagttacgaacctatacgaggtcggacgtacccgaggacaaggaacgacggagactagactattacgtgtactatcgtagacggatacgcgtacggttgttctacgtagttggtaggtacgttcgggacgggacgggtacgaacggtcgtaccggtccgttacggtaacggacgacggtacccgacggtcccgtacccggtccccgttacccg

SEQ ID NO: 338094 - DNA, 603 bp, Homo sapiens
  misc_feature: GZ8MTXP02HXDSS.52.50.E06.1.454.CMB.2.raw
  modified_base (263)..(263): a, c, t, g, unknown or other
  misc_feature (263)..(263): n is a, c, g, or t
tcagcgcagtacgacacgaccggtgctcgatttagatctactgacaacacacaagggggtgggtccaggaggcagaactctgggtgtctcaccatggcctggatccctctacttcctccccctcctcactctctgcacaggctctgaggcctcctatgaggtgacacagccaccctcggtgtcagtcgtccccaggacagacggccaggatcacctgctctggagaggcagttggacaaaacatataggattatggtaccggnagaagccaggccacggccctgtgtgtgatatataaagacgaagggacgacggcccccgaagggactacccgtgacgcgatacgtctcggctaccagcctagacgggacacgtacgtacactacgttacgaccattaccgagtacggacgtacacggacgaagaagacgaggtcgtacgactattactgtacgtaatcgtagacggaacagacgtagttcggttactcgtaagtggttacggttacgttaccggggagggacgggtaccgaaacggtcggtacgtacccggtacgtaacggtcgaaccgacccgaaaggtccctaccggcccccgttaccg

SEQ ID NO: 338095 - DNA, 595 bp, Homo sapiens
  misc_feature: GZ8MTXP02I7E5M.52.50.E06.1.454.CMB.2.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagcccaccctcggtgtcagtcgtccccaggacagacggccaggatcacctgctctggagaggcagttggacaaaacaatatggatagttggaccgnagagcagcagccctgtgtgnatanataagagaggagacggaccccgagggactcccgngacgcgatactctcggctccagcctcgagggacacgacgtcactattcgaccatcgaagtggaacgtcgaggacaaggaacgaccggaggcgtagtaacgttattactagtactaactcgtacgacggacaggcgtaaggttcgttaccgtagtagttggtacggttaacggttcggggacggggtaacgggacccgaagtccgtacggtaaccccgttacgtaacggtaccgaccggtacccgaaacggtcccgttaccggacccccgttccgg

SEQ ID NO: 338096 - DNA, 581 bp, Homo sapiens
  misc_feature: GZ8MTXP02FV52H.52.50.E06.1.454.CMB.2.raw
  modified_base (273)..(273): a, c, t, g, unknown or other
  misc_feature (273)..(273): n is a, c, g, or t
  modified_base (400)..(400): a, c, t, g, unknown or other
  misc_feature (400)..(400): n is a, c, g, or t
  modified_base (462)..(462): a, c, t, g, unknown or other
  misc_feature (462)..(462): n is a, c, g, or t
  modified_base (491)..(491): a, c, t, g, unknown or other
  misc_feature (491)..(491): n is a, c, g, or t
tcagcgcagtacgacacgaccggtgctcgatttagatctactgacaacacacaagggggtgggtccaggaggcagaactctgggtgtctcaccatggcctggatccctctacttcctccccctcctcactctctacacaggctctgaggcctctatgaggtgacacagccaccctcggtgtcagtcgtccccaggacaggacgccaggatcacctgctcgtggagagctagttaggaacaaaactatagtaggtaattagttcggtaccgganaagaacgccgaggccgacggccccttggtggttggagtaataattaagaaagacggagggaacgaccggaccccgagggacctcccgagagcactactcgtgccctccgagctacgacggacaacgngtaccatagttacgactagtagcgagtaccgaggacaaagacgagagctagacttatacgtntacgatcgtaggacgacagtgtagtgtcntagtcgtagtgtacggacggacgaactacggcgtacgtaccgtacgtacgaccgaacgaccgaacgcccgtaccgcccgtcgtacttccg

SEQ ID NO: 338097 - DNA, 696 bp, Homo sapiens
  misc_feature: GZ8MTXP02GBP2J.52.50.E06.1.454.CMB.2.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
tcagcgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagcccaccctcggtgtcagtcgtccccaggacagacggccaggatcacctgctctggagaggcagttggacaaaacatatggatagttggacgnagagcaggcagccctgtgtgnatanataagagagggacgacggaccccgaggactcccgtggacgacgatactcgtccggcctaccgagccgtacgacgggaacacgtacgtaccaactacgttacgaacctaacgtacgtaaggtacggaaccgtacccggaagggacgaaacgggaaacggacgggaacgggtccgtaaggtaacctttaacgtttaaacgtcgttaaaccgaaagttccgtacggacgggaacgaacggtcgtaacgggtttcggtttcctacgtaggtttggggtacggtttacggttacgggggaccggggtaaaacgggtacccggaaaggtccgttaaccgggtaccccggtttaccggtaaccgggttaccgaccgggacccggtaaccgggtcctaccccgggtcccccgtttccgg

SEQ ID NO: 338098 - DNA, 494 bp, Homo sapiens
  misc_feature: GZ8MTXP01AH3VC.38.20.B09.1.454.CMB.2.raw
  modified_base (235)..(235): a, c, t, g, unknown or other
  misc_feature (235)..(235): n is a, c, g, or t
  modified_base (342)..(342): a, c, t, g, unknown or other
  misc_feature (342)..(342): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
  modified_base (492)..(492): a, c, t, g, unknown or other
  misc_feature (492)..(492): n is a, c, g, or t
tcagtcgatcacgtcacgaccggtgctcgatttagtgtagtgtgaagggagctacaacaggcaggcagggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccgagtgtttanacaactccaagataagagttcttagcttggtaccagcagaaaccacgacagcctcctaagctgctcgtttactgggccctcgtaccgggatccggggtcctgaacgnttcagtggcggcggtctgggcagatttcactctcaccatcagcagcctgcggctgaagatgngcgttattactggtcagcagtatatgtactctnactagtttgccaagggccaagcttggagattcgcacgaactgtggctgcaaccgntc

SEQ ID NO: 338099 - DNA, 515 bp, Homo sapiens
  misc_feature: GZ8MTXP01D079M.38.20.B09.1.454.CMB.2.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (376)..(376): a, c, t, g, unknown or other
  misc_feature (376)..(376): n is a, c, g, or t
  modified_base (506)..(506): a, c, t, g, unknown or other
  misc_feature (506)..(506): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggatgtttanacaactcaaagaataagagttcttagcttggtaccagacagaaaccacgacagcctacctaagctgctcgttacnggccctcgtaccgggatcccggggtcctagaacgtacttcgagtggcggcggtctgggaacngtattcactctcacatcagcagcctgcggctagaagagtgtgtcggtttatactggtcagctagtattatgttactctctactagtttgccgaagggaccaggtcgttagagattcgcacgaagtgtgcngctcgctcg

SEQ ID NO: 338100 - DNA, 559 bp, Homo sapiens
  misc_feature: GZ8MTXP01EUD0F.38.20.B09.1.454.CMB.2.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaaagaataagagttcttagcttggtaccagacaagaaacccacgacagcctacctaagctgcttcgtttacngggccctcgtacccgggaatcccgggggtcctagaacgtacttcgaggtgggccggcgggtactggggaactagtactttcactctacaccatcagcacgcctggcgggactagaagtagtggtggtcggtttattactggtcagactagtattatcgttactcctctactagtttcggcgtaagggaccaaggcgttaggacgagttcgcacgtaacgtggtcgctcgactaaccttgtc

SEQ ID NO: 338101 - DNA, 505 bp, Homo sapiens
  misc_feature: GZ8MTXP01AVHR3.38.20.B09.1.454.CMB.2.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcagagggccacgatcaactgcaagtccagccggagtgtttanacaactcaagaataagngttcttagcttggtaccagcagaaaccacgacagcctctaagctgctcgtttacngggccctgtacccgggatccggggtcctgaacgattcagtggcggcgggtctggggcagatttcactctcaccatcagcagcctgcggctgaagatgtgcggtttattactggtcagctagtattatgttactcctctactagtttggccaaggggtaccaagcttggagattcgcacgaatgtggctgcnccntc

SEQ ID NO: 338102 - DNA, 536 bp, Homo sapiens
  misc_feature: GZ8MTXP01CRME8.38.20.B09.1.454.CMB.2.raw
  modified_base (239)..(239): a, c, t, g, unknown or other
  misc_feature (239)..(239): n is a, c, g, or t
  modified_base (385)..(385): a, c, t, g, unknown or other
  misc_feature (385)..(385): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagacaagaaaccacgacagcctctaagctgctcgttactggccctcgtacccgggatcccggggtcctgaacgtacttcgagtggcggcgggtctgggcagtatttcactcncaccatcagcagcctggcgggctgaagatgtggtcgtttatacgtggtcagtctagtattatgttactcctctactagtttcgccgaaggggtaacaggtcttgggaacgtcgttcggcacggtaactggtcggctgcctaaccgaattcg

SEQ ID NO: 338103 - DNA, 556 bp, Homo sapiens
  misc_feature: GZ8MTXP01D6AU4.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaaagaataagagttcttagcttggtaccagacagaaaccacgacagcctctaagctgctcgtttacngggcccttcgtacccgggaatcccggggtcctagaaccgtattccgagtggcggcggtctgggcagtatttccactctcaccatcagcagcctgcgggctagaagagtggtggtcggtttaattacgttggtacgtagactagttattagtgttactcctctacgtagtttcggccgtaagggaccaaggcgttggagtattccgcaacgaacgtgtcggtctcggactaaccgttaagttcg

SEQ ID NO: 338104 - DNA, 495 bp, Homo sapiens
  misc_feature: GZ8MTXP01BE19B.38.20.B09.1.454.CMB.2.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (492)..(492): a, c, t, g, unknown or other
  misc_feature (492)..(492): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttacngggcctctaccgggatccgggtcctgaacgnttcagtggcgcggtctgggcagatttcactctcaccatcagcagcctgcggctgaagagtgtgtcggttattactggtcagcagtatatgttactctctactgtttcgctaagggcagcttggagattcgcacgaactgtgctgctccntcg

SEQ ID NO: 338105 - DNA, 556 bp, Homo sapiens
  misc_feature: GZ8MTXP01DY9CI.38.20.B09.1.454.CMB.2.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (320)..(320): a, c, t, g, unknown or other
  misc_feature (320)..(320): n is a, c, g, or t
  modified_base (550)..(550): a, c, t, g, unknown or other
  misc_feature (550)..(550): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcgagagggccacgatcaactgcaagtccagccggagtgtttanacaactcaagaataagngttcttagcttggtaccagacaagaaacccacgaacagccctacctaagctgcttcgtttacnggccctcgtacccgggatcccggggcctgaacgacttcagtggcggtcgggtctgggaacagtatttcactctacaccatcagcagcctgcgggctagagatgtggtacgtttatactggtcagtactagtattatcgttactcctctacgtgtttcggaccctaagggggacccaaggtcgttagggagtattcggcacgtaacgtggtcggctcggacctaaccgttnttcccg

SEQ ID NO: 338106 - DNA, 353 bp, Homo sapiens
  misc_feature: GZ8MTXP01BIOUX.38.20.B09.1.454.CMB.2.raw
  modified_base (350)..(353): a, c, t, g, unknown or other
  misc_feature (350)..(353): n is a, c, g, or t
tcagtcgatcacgtcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggctacttccacgtgatcgactgagcgggctggcaaggcgcatagnnnn

SEQ ID NO: 338107 - DNA, 586 bp, Homo sapiens
  misc_feature: GZ8MTXP01EFHLE.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactaccaagaataagagttcttagcttggtaccagacaagaaaccacgacagcctacctaagctgcttcgtttactgggccctcgtaacccgggattcccgggggtccctaggaacgtacttcgaggtcgggccgggtcggggtactaggggcagtactttccactctacacctatcagcacgccgtggcgggactagaagagtggtggtacggtttattacgtggtacgagtactagttattagttcgttacctacctctacgttacggtttcggccgtaaggggaaccaagcgttaggacgtattcgcgacgtaacgtgtggctgactaaccgttaattcg

SEQ ID NO: 338108 - DNA, 532 bp, Homo sapiens
  misc_feature: GZ8MTXP01BKY4B.38.20.B09.1.454.CMB.2.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (498)..(498): a, c, t, g, unknown or other
  misc_feature (498)..(498): n is a, c, g, or t
  modified_base (527)..(527): a, c, t, g, unknown or other
  misc_feature (527)..(527): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactcaaagaataagagttcttagcttggtaccagcaagaaaccacgacagcctctaagctgctcgttacnggccctcgtacccggggatcccgggggtcctgaacgtacttcgaggtggccggcgggtacgtgggaacctaggtactttccactcctcacatcagcagctgcgggctgagagtgtggtcgtttatctggtcagctagtattagtgttactcctctagtgtttcggcgaagggaccaagcttaggagnttcgcaacgaacgtgtggctgacctaacngttcg

SEQ ID NO: 338109 - DNA, 561 bp, Homo sapiens
  misc_feature: GZ8MTXP01A3C53.38.20.B09.1.454.CMB.2.raw
  modified_base (241)..(241): a, c, t, g, unknown or other
  misc_feature (241)..(241): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagtgtttanacaactcaagaataagagttcttagcttggtaccagacagaaaccacgacagcctcctaagctgtctcgtttactcgggccctcgtacccgggatcccggggtcctagaacgtcttcgaggtgggccggcgggtactgggaacaggtactttcacgtctacacatcagcacgcctggcgggctaggagtagtggtggtacggtttattacgtgggtactagctaagttattaattcgttactcctcgtacgtagtttcggcgtaagggaccagtcgttggagtacttcgcacgtaactggtcggctcgactccgttgttc

SEQ ID NO: 338110 - DNA, 582 bp, Homo sapiens
  misc_feature: GZ8MTXP01BMLLE.38.20.B09.1.454.CMB.2.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactccaagaataagagttcttagcttggtaccagcaagaaaccagacagccctcctaagctgctcgtttacngggccctcgtaccccgggaattcccggggtacctgaacgtacttcgaggtggcggcgggtacgtgggcgagtattcgactcgtcaccatcagcacgcgtgcgggcgtgaagatgtggtcgttattactgggtcagtctagttattagttcgttacttacctctaccgttaggttttcggccgtaacggggtaaccaaggtaccgttgggaacgtacgttccggcaacgtaaccgtggtcgggtccgtggacctaaccgttaagtttccg

SEQ ID NO: 338111 - DNA, 586 bp, Homo sapiens
  misc_feature: GZ8MTXP01DZ1US.38.20.B09.1.454.CMB.2.raw
  modified_base (241)..(241): a, c, t, g, unknown or other
  misc_feature (241)..(241): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagactccctggctgtgtctcgtgggcagagggccacgatcaactgcaagtccagccggagttgtttanacaactacaagaataagagttcttagcttaggaccagacaagaaaccacgacagccctacctaagctgcttcgtttacgtcgggccctacgtaccccggggaattccccgggggtcctaggaaccgtattccgaggtcgggccgggcgggtcgtggggaactaggtactttccactctacacctatcagcagcctggcggactagaagtatggtgtcggtttattacgtgggtacagtactagttattatcgttactcctctacgtagtttcggcggtaagggaaccgaagtccgttaggagtacgttacgcaacgaacgtggtcggctcgactaaccgttgtcg

SEQ ID NO: 338112 - DNA, 607 bp, Homo sapiens
  misc_feature: GZ8MTXP01ATYVN.38.20.B09.1.454.CMB.2.raw
  modified_base (240)..(240): a, c, t, g, unknown or other
  misc_feature (240)..(240): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagacctccctggctgtgtctcgtgggcgagagggccacgatcaactgcaagtccagcggagttgtttanacaactcaagtaataagtagttcttagcttaggtaccagacaagaaaccacgacacgccctacctaagctgccttcgtttacgtcgggtcccttaccgtaccccggggaattccccgggggtaccctaggaaaccgtacttccgaggtcggggccgggtcggggtctaggggaacaggtactttccacttctaccactatcagcacgccgtggcgggacgtagaagtagtggtgttacggtttattacgtgggtcagtctaagttattagttcgttacttccgtactacgttaggtttcggcgtaacgggtaccaggacgttaggagacgttcgcgacgtaactggtgtcgtcgaccnccgttntcg

SEQ ID NO: 338113 - DNA, 646 bp, Homo sapiens
  misc_feature: GZ8MTXP01ESIYF.38.20.B09.1.454.CMB.2.raw
  modified_base (239)..(239): a, c, t, g, unknown or other
  misc_feature (239)..(239): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccgagtgtttanacaactcaagaataagagttcttagcttggtaccagacaacgaaccaacgacacgacctacctacgctcgtcttacgttacgtcggtccctactacggtaccggtacggtacccgggtacccgtacgaacgtactacgtaggtcgggtcggggtcgggtcgggtacgggacgaacgttacgttactacctacctacccaacctactacgacgacgaccgccgtcggacgggcggtagaaaggtagtaggtacgggttacggtttacgtttacgttacgtacgtacgtacgtaagttaattaagttacgtttaccttacccttaccgtaacgttaacggtttaccggttaccgggaccggggtaaccggtaacgtaacggtagggaagttacgtaacgaaccgtaacg

SEQ ID NO: 338114 - DNA, 559 bp, Homo sapiens
  misc_feature: GZ8MTXP01DHK5F.38.20.B09.1.454.CMB.2.raw
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
  modified_base (554)..(554): a, c, t, g, unknown or other
  misc_feature (554)..(554): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgagagggccacgatcaactgcaagtccagccggagtgtttanacaactcaagaataagagttcttagcttaggtaccagacaagaaaccacgacagcctactaagctgcttcgtttacgngggccctacgaccgggatcccgggggtccngaacgtacttcgaggtggcggcgggtactgggaacagtactttcactctcaccatcagcagccgtggcgggctagaagagtggtgtacggtttattacgtggtcagtctagttattatcgttactcctctacgtaggtttcggccgaagggtaccaaggcgttaggacgattccgcacgtaacgtggtcgcgtcgacctaaccgnttccg

SEQ ID NO: 338115 - DNA, 546 bp, Homo sapiens
  misc_feature: GZ8MTXP01DM4YT.38.20.B09.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
  modified_base (399)..(399): a, c, t, g, unknown or other
  misc_feature (399)..(399): n is a, c, g, or t
  modified_base (508)..(508): a, c, t, g, unknown or other
  misc_feature (508)..(508): n is a, c, g, or t
  modified_base (525)..(525): a, c, t, g, unknown or other
  misc_feature (525)..(525): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagngttcttagcttggtaccagcaagaaaccacgacagcctctaagctgctcgtttacngggcccttcgaccgggaatcccgggggtccngaacgattcgagtggccggcgggtctggggaacagactttcactctcaccatcancagcctgcgggactagaagagtgtggtcggtttattacctggtcagctaggttattagtgttactcctctactagtttcggccgaaggggtaccaaggtcttgggaagnttacgcaacgaactggnggctcgctaaccttaagttcg

SEQ ID NO: 338116 - DNA, 502 bp, Homo sapiens
  misc_feature: GZ8MTXP01DH0G6.38.20.B09.1.454.CMB.2.raw
  modified_base (237)..(237): a, c, t, g, unknown or other
  misc_feature (237)..(237): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (499)..(499): a, c, t, g, unknown or other
  misc_feature (499)..(499): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactccctggctgtgtctctgggcgagagggcacgatcaactgcaagtccagccggagtgtttanacaactccaaagaataagagttcttagcttggtaccagcagaaaccacgacagcctactaagctgctcgttactggtcctctacccgggatccggggtcctgacgactcgagtggcgcggtctgggcagtatttcactctcacatcagcagctgcggctganatgngtcgttatactgtcagtctagtattatgttactcctctactagtttcgcgaagggaccaagtcgttgagagttcgcacgaactgtgctgctaacgngtc

SEQ ID NO: 338117 - DNA, 547 bp, Homo sapiens
  misc_feature: GZ8MTXP01AH1JB.38.20.B09.1.454.CMB.2.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaaagaataagagttcttagcttggtaccagacaagaaaccacgacagccctacctaagctgctcgtttacnggcctcgtaccgggatccgggtcctgaacgnttcgaggtcggcggtcggtctggggaacagtactttcgacctctcacatcagcagcctggcggctagaagagtgtggtcggttattactgggtcagcagttattatgttactcctctacgtagtttcggcgtaaggggtaccaaggtcgttagggagtaacgttcgcgacgaacgtggtcggctgctaaccgaagttcg

SEQ ID NO: 338118 - DNA, 553 bp, Homo sapiens
  misc_feature: GZ8MTXP01A93OV.38.20.B09.1.454.CMB.2.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggcgagagggccacgatcaactgcaagtccagccggagtgttttanacaactccaaagaataagagttcttagcttggaccagacagaaaccncgacagcctctaagctgctcgttacnggccctcgtacccgggatcccgggtcctgaacgacttcgagtggcggcggtctgggcagatttcactctcaccatcagcagcctgcggctagaagagtggtggtacggtttattacgtggtcgagctagtattatgttactcctctacgtaggtttcgggccgaacgggggacccttaaaggccgttagggacgtaagttccggcacggtaacgtggtcggctcggccaacccgttcgtcg

SEQ ID NO: 338119 - DNA, 649 bp, Homo sapiens
  misc_feature: GZ8MTXP01APVWV.38.20.B09.1.454.CMB.2.raw
  modified_base (239)..(239): a, c, t, g, unknown or other
  misc_feature (239)..(239): n is a, c, g, or t
  modified_base (418)..(418): a, c, t, g, unknown or other
  misc_feature (418)..(418): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactacaagtaataagtagttcttagcttacggtaccagacaacgaaaccacgacacgcctactaagctgcttcgttacgcggccctccgtacccggacgtcccgggtcctaggaactacttcgaggtcgggcgggtcggtacgtaggggaacctagtactttacactcctacacancacgcacgccgtggcggactagaagtagtggtggtacggtttacttacgtggtacgagtactaagttatttacgttacgtttaccttacccttactaccgtttacggttttaccgggacccggtaaacgggggaacccttaaggtaccggttaggaaacggtacgttaccggaccgaaccggtaaaccgtttgggaacggtcctacggaccctaacccgttaactttcccg

SEQ ID NO: 338120 - DNA, 524 bp, Homo sapiens
  misc_feature: GZ8MTXP01BI4U8.38.20.B09.1.454.CMB.2.raw
  modified_base (238)..(238): a, c, t, g, unknown or other
  misc_feature (238)..(238): n is a, c, g, or t
  modified_base (421)..(421): a, c, t, g, unknown or other
  misc_feature (421)..(421): n is a, c, g, or t
  modified_base (491)..(491): a, c, t, g, unknown or other
  misc_feature (491)..(491): n is a, c, g, or t
  modified_base (521)..(521): a, c, t, g, unknown or other
  misc_feature (521)..(521): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactccaaagaataagagttcttagcttgtaccagcaagaaaccacgacagcctacctaagctgcttcgtttactcgggccctcgtaccccgggaatcccgggggtcctggaacgcttcaggtcgggcggcgggtctgggcagtatttcactctcacatcagcagcctggcggctagaagngtgtgtcggtttatacgtggtcagcagttattatgttactcctctactagtttcggcgaagggacagtcnggagattcgcacgaactgtcgctgctaacntcg

SEQ ID NO: 338121 - DNA, 599 bp, Homo sapiens
  misc_feature: GZ8MTXP01BQ6SE.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactaccaagaataagagttctttagcttggtaccagacaagaaaccacgacagccctactaagctgccttcgtttacgtcgggccctacgtaacccgggggaatcccgggggtcccctaggaaccgtactttcgaggtcgggccgggtccggggtacgtaggggcaggtacttttccaaccttccgtaccacctatccacgcgacgccgtggcgggctaggaagagtggtggtacggtttattacgtgggtcagtctagttattagttgttactcctctacgttaggtttcggccgtaagggtacccaaggcgttggagattccgcgacgaacgtgtcggctcgcaaccttgttcg

SEQ ID NO: 338122 - DNA, 513 bp, Homo sapiens
  misc_feature: GZ8MTXP01EPNX7.38.20.B09.1.454.CMB.2.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (511)..(511): a, c, t, g, unknown or other
  misc_feature (511)..(511): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactcaagaataagagttcttagcttggtaccagcaagaaaccacgacagcctacctaagctgctcgtttacngggccctcgtaccgggatccgggtcctgaacgtattcgagtggcggcggtctgggcagtactttcactctcaccatcagcacgctggcggctgaagatgtgtcggttattactggtcagctagtatatgttactctctcgtagtttggcgaagggaaccaaggcgttggagattcgcacgaactgtcgcgtgcaacgntc

SEQ ID NO: 338123 - DNA, 611 bp, Homo sapiens
  misc_feature: GZ8MTXP01CDV8F.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagttgtttanacaactcaagaataagagttcttagcttggaccagacaagaaaccacgacagccctactaagctgtccttcgtttacgcgggccctacgtacccggggattcccgggggtcctagaacgtacttcgaggtcgggcggtcggtctagggcagtactttcactctcacatcagcacgccgtggcggactagaagtagtggtggttacgtttattacgtggtacgtagtacgtagttattacgttcgtttaccttaccgtactaacgttaggtttcggaccggtaacggggtaaccaggtcgttagggtaacgtacgttaccgcgttaacgtaacgtcgggtcggtcgtcgacctaaccgttaacgtttccg

SEQ ID NO: 338124 - DNA, 580 bp, Homo sapiens
  misc_feature: GZ8MTXP01BS7JM.38.20.B09.1.454.CMB.2.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaagtccagccggtagtgtttanacaactcaagaataagagttcttagcttggtaccagacaagaaaccacgacagccctactaagctgcttcgtttacgnggccctacgtacccgggactcccggggtcctagaacgtacttcgaggtcgggcggcgggtactgggaacagtactttcactctcacatcagcacgcgtggcggacgtagaagtagtggtggtcggtttattacgtaggtcgtagtactagttatttattcgttacctcctcgtacgtagtttcggaccggaacgggaccgaaggtcgttaggacgtacgttcgcgacgtaacgtgtcggctcgacctccgttaacgttcg

SEQ ID NO: 338125 - DNA, 629 bp, Homo sapiens
  misc_feature: GZ8MTXP01A03N2.38.20.B09.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccgtagtntttanacactacaagaataagtgttcttagcttggtaccagacagaaaccacgacagccctactaagctgccttacgtttacncgggccctacgtaccccgggagtccccgggggtacctggaaccgtattcgaggtcggggccgggtcggggtactgggaactagtactttccacctctaccaacctatccagcacgccctggcgggtctagaagtagtggttggtacggtttattaccgtggggtactaggtactaagttatttaagttcgtttaccttccttactaaccgttaggttttcgggaccggtaacgggggaaccttaacgggtccgttagggacgtaacgttccgacgacgtaacgtggtcggcgtcggacctaacccgttgtcg

SEQ ID NO: 338126 - DNA, 602 bp, Homo sapiens
  misc_feature: GZ8MTXP01C1U20.38.20.B09.1.454.CMB.2.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
  modified_base (419)..(419): a, c, t, g, unknown or other
  misc_feature (419)..(419): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacgatacaactgacaagtccagccggtagttgtttanacaactcaaagaataagnttcttagcttaggtaccagacaagaaaccacgacacgccctactaagctgcttcgtttacncgggtaccctcggaaccccgggtatcccgggggtccctggaaacctcttcgaggtcgggccggcgggtctagggctagtctttcactctcaccntacagcagctggcgggctagagtagtggtggtcgtttattacgtggtcagtctagtattatcgtttactccgtactacgtacggtttcggaccgtaacgggggaaccttaaaggtccgttagggtaacgtacgttccgcgttaacggtaacgtgggtcggtctcgacctaaccgttaacttcg

SEQ ID NO: 338127 - DNA, 518 bp, Homo sapiens
  misc_feature: GZ8MTXP01DYS8C.38.20.B09.1.454.CMB.2.raw
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcgagagggccacgatcaactgcaagtccagccggagtgtttanacaactccaagaataagagttcttagcttggtaccagcagaaaccacgacagcctactaagctgcttcgttactggccctcgtaccgggatccggggtccngaacgtcttcgagtggcggcggtctgggcagtatttcactctcaccatcagcacgcctgcgggctagaagagtgtgtcggtttattacgtggtcagtctagtattatcgtactcctctactagtttcgcgtaaggaccagcgttgagnttcgcacgaactgcgctgcncttaagtcg

SEQ ID NO: 338128 - DNA, 562 bp, Homo sapiens
  misc_feature: GZ8MTXP01BVB7Q.38.20.B09.1.454.CMB.2.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagtcgatcacgtcacgaccggtgctcgatttagtgtagtgtgaagggggagctacaacaggcaggcaggggcagcaagatggtgctgcagacccaggtcttcatttctctgttgctctggatctctgttactacaggtgcctacggggacatcgtgatgacccagtctccagactccctggctgtgtctcgtgggcgagagggccacgatcaactgcaagtccagccggattgtttanacaactccaaagaataagagttctagcttggtaccagcaagaaaccacgacagccctctaagctgcttcgtttacngggcctcgtacccggatcccggggtcctgaaccgnttcgaggtggcggtgggtctggggactaggtactttcgacttcacaccatcagcacgccgtggcgggctagaagtagtggtggtacgtttattacggtgtcgagctagttattagttgttactcctctacgttcgtttggccgtaaggggaccaacggttcgtaggagcgttcgacgtaacgtacgtggtcggcgttcgccgaaccgtaag

SEQ ID NO: 338129 - DNA, 640 bp, Homo sapiens
  misc_feature: GZ8MTXP01DNLSS.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctcagactccctgctgtgtctcgtggcgagacgggccacgatcaactgacaagtccagccggtagttgtttanaacaactacaaagaataagtagttacttagcttaggaccagacaagaaaccacgacacgaccctactaagctcgtcttcgtttacgtcgggacccttacgtaacccggggtagttccccggggtacctaggaaccgtcttccgagggttcgggccgggtcgggtccgtaggggaactagtactttccactcctacaacctatcacgcacgccgtggacgggactaggaagtagtggttaggtacggtttaattaccgtggtacgtagtactaagttattacgttcgtttaccttcctactacgtttaggtttcggccggtaagggaccgaaggtcgttaggacgtcgttacgcgaacgtaacgtgggttcgccgtacgttacctaaccttaacgtttccg

SEQ ID NO: 338130 - DNA, 650 bp, Homo sapiens
  misc_feature: GZ8MTXP01ECBEE.38.20.B09.1.454.CMB.2.raw
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctcagactccctggctgtgtctcgtgggcgagagggccacgatcaactgcaagtccagccggtagttgtttanacaactcaaagaataagtagttactttagcttggtaccagacaacgaaaccacgacagcctactaanctgcttcgtttacgcggccctacgtaccgggtatcccgggtcctagaactacttcgaggtcggcggcggtactgggaactagtactttcgactctacacctatacagcacgccgtcggcgggactaggaagtagtggtacgggttacgtttaacgttaccgttaggggttacgaaggtacctaaggttaactttagttacgtttaccttcccgttacgtacgttacggttttacgggcccggtaaacgggggtaacccaagggtcgttagggtaacgtacgttaccggacgttaacggtaacgttcgggtcggtcgtacggacctaacccgttaagtttccg

SEQ ID NO: 338131 - DNA, 614 bp, Homo sapiens
  misc_feature: GZ8MTXP01DX0QB.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgagagggccacgatcaactgcaagtccagccggagttgtttanacaactcaaagaataagagttcttagcttggtaccagacaagaaaccacgacagcctacctaagctgtcttcgtttactcgggccctacgtaccccggggaattccccgggggtaccctaggaaaccgtacttccgaggtcggggccgggccggggtctaggggaacaggtactttccacttcctacacctatcagcagccgtggcgggactagaagtagtggtggtacgtttattacgtggtacgagtactagttattagtcgttaccttcctactacgttaggtttcggccgtaagggtaacccaaggtccgttaggagtaacgttccggacaccgtaacgtggtcggcgtcgacctaaccgttgttccg

SEQ ID NO: 338132 - DNA, 677 bp, Homo sapiens
  misc_feature: GZ8MTXP01COVI2.38.20.B09.1.454.CMB.2.raw
  modified_base (240)..(240): a, c, t, g, unknown or other
  misc_feature (240)..(240): n is a, c, g, or t
  modified_base (619)..(619): a, c, t, g, unknown or other
  misc_feature (619)..(619): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgaccagtctccagactccgtggctgtgtctcgtgggcgagacgggccacgatcaactgacaagtccagcggtagtgtttanacaactcaaagataagagttcttagcttggtaccagacaagaaaccacgacacgccctacaagctgtccttcgtttacgcggtaccctaccggtaaccccggggaattccccgggggtaccctaggaaaccgtacgttccgagggttcggggaccgggtcggggttacgtaggggaacctaggtaactttccaacctcctacgacctatacgacgcgacgtccgtggtaccgggacgttaggaaagtagttggtacgggttacggtttaacttacggtgggtacctaaggtactaaggtttagttacgtcgggttaccgttccgtccggtcttaccgtaaccggtttcggggaacgggtaaacggggaccgtaaggggnggtaaacgtagttacgaacggacgtaacgtggtcggcgtacggactaaccgttgttcg

SEQ ID NO: 338133 - DNA, 583 bp, Homo sapiens
  misc_feature: GZ8MTXP01CNTGP.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggagggccaacgatcaactgcaagtccagccggagttgtttanacaactcaaagaataagagttcttagcttaggtaccagacaacgaaaccacgacagcctacctaagctgcttcgtttactcgggccctaccgtaacccggggaatccccgggggtacctagaaccgtacttcgaggtcggcgggtcgggtactaggggaactagtactttccacgtcctacaacatcagcacgccgtgcgggacgtagaagagtgtggtacggtttattacgtggtctagtcagttattatcgttactcctcgtactagtttcggcgaagggacaagtcgttaggagacttcgcacgtaacgtcgtggctgacctaaccgttaacttcg

SEQ ID NO: 338134 - DNA, 559 bp, Homo sapiens
  misc_feature: GZ8MTXP01CAD1M.38.20.B09.1.454.CMB.2.raw
  modified_base (241)..(241): a, c, t, g, unknown or other
  misc_feature (241)..(241): n is a, c, g, or t
  modified_base (405)..(405): a, c, t, g, unknown or other
  misc_feature (405)..(405): n is a, c, g, or t
  modified_base (554)..(554): a, c, t, g, unknown or other
  misc_feature (554)..(554): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagttgtttanacaactcaaagaataagagttcttagcttaggtaccagacaagaaaccacgacagcctactaagctgcttcgttactgggccctcgtacccgggatcccggggtcctagaacgtacttcgaggtcgggcggtcgggtctggggaacagtactttcactctcacntcagcagccgtgcgggctagaagagtggtggtacgtttattaccgttggtactagtctagttattatcgttactcctctactagtttcggcgtaaggggaccaagcgttggacgacttcgcacgtaacgtggtgctcgacctaacgttnttccg

SEQ ID NO: 338135 - DNA, 707 bp, Homo sapiens
  misc_feature: GZ8MTXP01DEST2.38.20.B09.1.454.CMB.2.raw
  modified_base (246)..(246): a, c, t, g, unknown or other
  misc_feature (246)..(246): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggacgggccacgatcaactgacaagtccagccggtagttgtttanacaactaccaaagaataagtagttacttagcttaggaccagacaacgaaaccacgacacgaccctacctaagtctcgtccttacggtttacgtcggggtccccttaccggtaaccccgggggtaacgttccccgggggtccctaggaaaccgtacgttccggaggtcggggccggggtccggggttacgtagggaacctaggtactttaccgaccttccgtacaccataccgagcgtacggccgtcgggcgggtacgtaggtaagtaggttggttagggttacggttttattaccgtgggtacgtagtactaaggttatttacgttcgtttaaccttcccgttacttaaccggttaggtttcgggacccgggtaaacgggggtaacccaaggtccggttagggaacgtcgttaccggcgttaacgtaacgtggtcgacgtcgacctaaccgttcgtttccg

SEQ ID NO: 338136 - DNA, 568 bp, Homo sapiens
  misc_feature: GZ8MTXP01E4AWS.38.20.B09.1.454.CMB.2.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactccaaagaataagagttcttagcttggtaccagcaagaaaccacgacagcctactaagctgcttcgttacnggcctcgtaccgggatccggggtcctgaacgtcttcagtcggcggcgggtactggggaactagtactttcactcgtacaccatcagcacgcctggcgggctagaagtagtggtggtacggtttattacgtggtacagctagttattattcgttactccgtactacgttaggtttcggccgaaggggaaccaaggcgttggaacgtacttcgcaacgtaacgtggtaacgggctgacctaaccttaagttccg

SEQ ID NO: 338137 - DNA, 536 bp, Homo sapiens
  misc_feature: GZ8MTXP01DK5IB.38.20.B09.1.454.CMB.2.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (468)..(468): a, c, t, g, unknown or other
  misc_feature (468)..(468): n is a, c, g, or t
  modified_base (534)..(534): a, c, t, g, unknown or other
  misc_feature (534)..(534): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagacgggccacgatcaactgcaagtccagccgagtgtttanacactcaagaataagnttcttagctggtaccagacagaaaccacgacagcctacctaagctgcttcgtttactcgggccctcgtacccgggaatcccgggggtccctgaacgtattccgaggtcggcggcgggtctggggaacagtactttacacttctcaccatcagcagcctggcggctgaagatggtgtcggtttatactgggtcagcagtattatgttactcctntactagttcggcgaaggggtaccaaggcttagagtaattcgcacgaactggtggctgctaaccttntc

SEQ ID NO: 338138 - DNA, 662 bp, Homo sapiens
  misc_feature: GZ8MTXP01CVNCL.38.20.B09.1.454.CMB.2.raw
  modified_base (250)..(250): a, c, t, g, unknown or other
  misc_feature (250)..(250): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtggggcgaggacgggccacgatcaactgacaacgtccaggccggtagttagtttanaacaactacaaagaataagtagttacttagcttaggtaccagacaagaaaccacgacacgaccctactaagctacgtcttacggtttacgtcggggtccccttacggtaaccccgggggtaacgttccccgggggtaccctaggaaaccgtacttccggaggtcggggccgggtccggggtacgtaggggaaccctaggttactttaccaccgttcctaccaacccatccagccacgccgtcggacgggctaggaagtagtggttcggttcggtttaacttacgttggtacgtagtctaaggttattagtcgttactcctactacgttaggtttcggccgaagggaccaaggtcgttaggacgtcgttacggcaacggtaacgtggtcgggctcggacctaacgttcttccg

SEQ ID NO: 338139 - DNA, 542 bp, Homo sapiens
  misc_feature: GZ8MTXP01CEWPB.38.20.B09.1.454.CMB.2.raw
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
  modified_base (424)..(424): a, c, t, g, unknown or other
  misc_feature (424)..(424): n is a, c, g, or t
  modified_base (515)..(515): a, c, t, g, unknown or other
  misc_feature (515)..(515): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccgatnttanacaactcaagaataagagttcttagcttggaccagcagaaaccagacagccctctaagctgctcgtttacncgggcccttcgtacccggggaatcccgggggtaccctggaaaccgtctttcgaggtggccggcgggtactgggcaggtatttcactctcaccatcagcagccgtgcggctagaagngtgtgtcggtttattacgtggtctagtctagtatagtgttactcctctacgtagtttgccgaagggtaccaagtcgttaggagtattccgnacgaactgtgctgcctaacgaacttcg

SEQ ID NO: 338140 - DNA, 618 bp, Homo sapiens
  misc_feature: GZ8MTXP01BDG8T.38.20.B09.1.454.CMB.2.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagtagttcttagcttggtaccagacaagaaaccacgacagccctactaagctgctcgttacnggccctcgtaccgggatcccggggtcctagaacgtacttcgaggtcgggcggtcgggtactggggaactagtactttcacctctaccaccatcacgcacgccgtggcgggacgtagaagtagtgtggtacgtttattacgtggtacgtagtactagttattagttcgttacttcctacgtacgtaggtttcggccggtaacggggtaacccgttaaaggtccgttagggaacgtaacgttaccggaccgaaccgtaacggtgggtaacgggtccgtacggacctaacccgttaacgtttccg

SEQ ID NO: 338141 - DNA, 537 bp, Homo sapiens
  misc_feature: GZ8MTXP01BE9LW.38.20.B09.1.454.CMB.2.raw
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (533)..(533): a, c, t, g, unknown or other
  misc_feature (533)..(533): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaactgcaagtccagccggagtgtttanacaactccaagaataagagttcttagcttggtaccagcagaaaccncgacagcctactaagctgctcgttacngggccctcgtacccgggatcccggggtcctagaacgnttcgaggtggccggcggtctggggcagtactttcactctacaccatcagcagcctggcggctagaagagtgtggtcggtttattacgtggtcagtctagttattattgttacttcctctacgttgtttcggccgaaggggaaccaaggcgttaggacgattcgcacgaacgtgtggctgctaacngtcg

SEQ ID NO: 338142 - DNA, 616 bp, Homo sapiens
  misc_feature: GZ8MTXP01DAKQT.38.20.B09.1.454.CMB.2.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagngttcttagcttggtaccagcaagaaaccacgacagcctcctaagctagcttcgtttactggggcccttcgtaccccgggggaattcccgggggtaccctgaaaccgtacttcgaggtgggcggcgggtctgggcagtatttccactctcaccatcagcagcctgcgggctgaagagtggtggtcggtttattacgtgggttcagtctaggttattagtcgttactccgttctacgttacggttttcggccgtaacgggggaacccttaaagggtccgttaggggaagtaacgttcccggttacgttaaaccggtaaaccgttggtcgggtccgttcggaccctaacccgttaactttccg

SEQ ID NO: 338143 - DNA, 584 bp, Homo sapiens
  misc_feature: GZ8MTXP01BOC6L.38.20.B09.1.454.CMB.2.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (567)..(567): a, c, t, g, unknown or other
  misc_feature (567)..(567): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactcctggctgtgtctcgtggcgagaggccacgatcaactgcaagtccagcgattgttanacactacaagatagnttctanctagacagacacgaaccacgacagccctactaagctcgcttacgtttacgcgggtccctacggtaacccgggacgttccccgggtctagaacgtcttcggaggtcgggcgggtcggtactggggaactagtactttcactctacactntcagcngccgtggcggtctaggtaacgtgtggtcgggttacgtttacgttacgtgggtacgaggtctaagttactttatcgttactccgtactacgttaggtttcggaccggaacgggtaacttacggtcgaggtacgcgttacgttcaacgtaacgttgcgtcncgactaacgttcgttcg

SEQ ID NO: 338144 - DNA, 559 bp, Homo sapiens
  misc_feature: GZ8MTXP01BK1RX.38.20.B09.1.454.CMB.2.raw
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (554)..(554): a, c, t, g, unknown or other
  misc_feature (554)..(554): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggatgttttanacaactcaaagaataagagttcttagcttggtaccagacaagaaaccacgacagccctactaagctgcttcgtttacnggccctcgtaccgggatccgggtccngacgtnttcgaggtcggcggtcggtacgtgggaacaggtactttcgactctacactatcagcacgccgtgcgggactagaagagtggtggtcggtttattacgtggtctagtctagttattagtcgttactcctctacgttaggtttcggcgtaagggaccaaggtcgttaggagagttcgcgacgaacgtggtgcgtcgctaaccgttnttccg

SEQ ID NO: 338145 - DNA, 353 bp, Homo sapiens
  misc_feature: GZ8MTXP01A26DG.38.20.B09.1.454.CMB.2.raw
  modified_base (348)..(353): a, c, t, g, unknown or other
  misc_feature (348)..(353): n is a, c, g, or t
tcagtcgatcacgtcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctgcaccctctccaagagcacctctggggcacagcggcctgggctgcctggtcaaggactacttccacgtgatcgactgaggcgggctggcaaggcgcatacgnnnnnn

SEQ ID NO: 338146 - DNA, 553 bp, Homo sapiens
  misc_feature: GZ8MTXP01DM2RJ.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagagttcttagcttggaccagcaagaaaccacgacagcctctaagctgcttcgtttactgggccctcgtacccgggatcccggggtcctgaaccattcgaggtggcggcgggtctgggcagtattcactctcacatcagcagcctggcggactagaagtagtggtgggtacggtttattacgtgggtacaggtctagttattagttgttacctcctactacgtagtttcggccgtaaggggaaccaggcgttggacgtagttcgcacgtaacgtggtgctcgacctaaccgaagttccg

SEQ ID NO: 338147 - DNA, 515 bp, Homo sapiens
  misc_feature: GZ8MTXP01APZQT.38.20.B09.1.454.CMB.2.raw
  modified_base (238)..(238): a, c, t, g, unknown or other
  misc_feature (238)..(238): n is a, c, g, or t
  modified_base (285)..(285): a, c, t, g, unknown or other
  misc_feature (285)..(285): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (513)..(513): a, c, t, g, unknown or other
  misc_feature (513)..(513): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaactgcaagtccagccggagtgtttanacaactcaaagaataatagttcttagcttggtaccagcaagaaaccncgacagcctcctaagctgctcgtttactgggcctcgtacccgggatcccggggtcctgaacgnttcagtggcggcggtcngggaacagatttcactctcacatcagcagcctgcgggctgaagatgtgtcggttattacgtgtcagcagtattatgttactcctctacagtttcggccgaagggtacccaaggcttggagattcgcacgaactgtggctgcaaccttntc

SEQ ID NO: 338148 - DNA, 524 bp, Homo sapiens
  misc_feature: GZ8MTXP01ARRHT.38.20.B09.1.454.CMB.2.raw
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgcaagtccagccggatgtttanacaactcaagataagagttcttagcttggacagcaagaaaccacgacagcctactaanctgctcgtttacnggtccctcgtacccgggatcccggggtcctgaacgcttcaggtggcggcggtctgggcagtatttcgactctcacatcagcagctgcggctagagagtgtggtcgttattactgtcagtctagttattattgttactcctctacgtgtttcggccgaagggaccaaggcgttggagcttcgcacgtaacgtgcggctcgctccgttaattccg

SEQ ID NO: 338149 - DNA, 630 bp, Homo sapiens
  misc_feature: GZ8MTXP01BCPE1.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggccacgatcaactgacaagtccagccggagttgtttanacaactcaagaatagagttcttagcttggtaccagacaagaaaccacgacacgccctacctaagctgtcctttacggtttacgcggggacccttaccgtaccccgggggaacgttccccgggggtaccctaggaaccgtacttcgaggtcgggcggggtcgggtacgtgggaactaggtactttcactctcactatcagcacgctggcggactagaagagtggtggtacgtttatacgtggtctaggactagttattagttcgtttacctacctacgtacgttacggtttacggccggtaacggggaccgttaaaggtcgttagggaacgtagttacggccttaacgggtaacgtggtcggtacgtcgacctaaccgttcgttccg

SEQ ID NO: 338150 - DNA, 515 bp, Homo sapiens
  misc_feature: GZ8MTXP01AO6ZG.38.20.B09.1.454.CMB.2.raw
  modified_base (240)..(240): a, c, t, g, unknown or other
  misc_feature (240)..(240): n is a, c, g, or t
  modified_base (512)..(512): a, c, t, g, unknown or other
  misc_feature (512)..(512): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactgggcctcgtacccgggatccgggggtcctgaacgattcagtggcggcggtctgggcagattcactctcacatcagcagctgcggctgagatgtgtcggtttatatggtctagcagttattatgttactcctctactagttttcggccgtaaggggaccaagcttggagattcgcacgtaactggtggctcgcaaccgngtc

SEQ ID NO: 338151 - DNA, 560 bp, Homo sapiens
  misc_feature: GZ8MTXP01A6PYI.38.20.B09.1.454.CMB.2.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (554)..(554): a, c, t, g, unknown or other
  misc_feature (554)..(554): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccagatcaactgcaagtccagccggagtgtttanacaactccaagaataagagttcttagcttggtaccaccaagaaaccncgacagcctacctaagctgcttcgttactcgggccctcgtacccggggaatcccgggggtcctaggaacgtnttccgaggtggcggcgggtctgggacngtatttccactctacacctatcagcacgccgtggcgggcgtaggaagtagtggtggtcggtttattacgtgtcgagtctaagttattattcgttactccttactacgtagtttcggaccgtaggggaaccaagcgtaggagtagtcgcgacgacgtgtggctgcacctnttcgtg

SEQ ID NO: 338152 - DNA, 608 bp, Homo sapiens
  misc_feature: GZ8MTXP01CONEX.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgaggagggccacgatcaactgacaagtccagccggagttgtttanacaactcaaagaataagagttcttagcttaggaccagacaagaaaccacgacagccctactaagctgccttcgttacgcggccctcgtacccgggatcccgggggtcctagaacgtacttcgaggtcgggcggcggtctgggcctagtactttcactctacacatcagcacgtccgtggtcgggactagaagtagtggtggtacgtttagttacgtggtcgagtctagttattatacgttaccttcctctacgttacggtttcggaccggtaacggggaaccaaaggtccgttaggacgtacgttaccggacgttaaccgtaacgtcgggtaacggcgtacggacctaacccgttaagtttccg

SEQ ID NO: 338153 - DNA, 349 bp, Homo sapiens
  misc_feature: GZ8MTXP01ANXOM.38.20.B09.1.454.CMB.2.raw
  modified_base (257)..(257): a, c, t, g, unknown or other
  misc_feature (257)..(257): n is a, c, g, or t
  modified_base (343)..(349): a, c, t, g, unknown or other
  misc_feature (343)..(349): n is a, c, g, or t
tcagtcgatcacgtcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcgtctcccctgcacctctcaagngcacctctggggcacagcggccctgggctgcctggtcaaggctacttccacgtgatcgactgagcgggctggcaaggcgcatacgnnnnnnn

SEQ ID NO: 338154 - DNA, 570 bp, Homo sapiens
  misc_feature: GZ8MTXP01DICXG.38.20.B09.1.454.CMB.2.raw
  modified_base (241)..(241): a, c, t, g, unknown or other
  misc_feature (241)..(241): n is a, c, g, or t
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactcctggctgtgtctcgtgggcgaggagggccacgatcaactgcaagtccagccggagttgtttanacaactcaaagaataagattcttagcttaggtaccagacaagaaaccacgacagcctacctaagctgcttcgtttacgngggccctcgtacccgggaatcccgggggtacctaggaacctnttcgaggtcgggcggcgggtctgggaacagtatttccactctcaccatcagcagcctggcgggctaggaagtagtggtggtacggtttattacgtggtcagtctagtattatgttactcctctactaggtttcggccgtaagggaccaaggtcgttggagtacgttacgcgaacgtaacgtggtcgtctcgccaaccgttaacgttcg

SEQ ID NO: 338155 - DNA, 782 bp, Homo sapiens
  misc_feature: GZ8MTXP01DUI0Q.38.20.B09.1.454.CMB.2.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (766)..(766): a, c, t, g, unknown or other
  misc_feature (766)..(766): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagttgtttanacaactcaagaataagnttcttagcttaggtaccagacaagaaacccacgacacgaccctacctaaagtctacggtcctttacggtttaccgtcgggggtacccccttaccgtaacccccggggggtaaacttcccccggggggttacccccttagggaaaaccccgttagtttcccgaaggggtcgggggtcccggggtccgggggttacccgttaggggggaaccctacgggtaaactttttcccgaaacccttcccttaccaaacccctagttaccgaacggtcccgaacggtcccccgttgggcccggggtaacgttaacgggaaaggttacggttgggttacggggtttcgggttttaaacgtttacgttcggggttaccgtaaggtaaccgttaaggtttaatttacgttacggtttacccttacccttacgtaacgttacggttttacgggccggtaaacggggtaaccgaaacggtcgttagggtaagcgttacgcgaacggtaacgtggtggtccncgactaacgttcgtcg

SEQ ID NO: 338156 - DNA, 609 bp, Homo sapiens
  misc_feature: GZ8MTXP01D3EKP.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagttgttttanacaactcaagaataagagttcttagcttggtaccagacaagaaaccacgacagccctactaagctcgtcttacgtttactcgggtcccttaccgtaacccggggaattccccggggtacctggaaccgtacttcgaaggttcgggccgggtcggggtacgtggggaactagtacgttttccactcctcacctataccagccagccgtggcgggactgaagtagtggtcgtcggttttaaattccgttggtctaggtactagttattatcgtttacctcctctacgttagtttcggctaaggggacccaaggccttgggaatcgttcgcaacgtaacgtggtaacgcgtgacctaacttaagtttccg

SEQ ID NO: 338157 - DNA, 554 bp, Homo sapiens
  misc_feature: GZ8MTXP01E1KZS.38.20.B09.1.454.CMB.2.raw
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
  modified_base (466)..(466): a, c, t, g, unknown or other
  misc_feature (466)..(466): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggagggccacgatcaactgacaagtccagccggtagttgtttanacaactccaaagaataagagttcttagcttggtaaccagacaagaaaccagacacgcctacctaagctgcttcgttacngggccctcggtacccgggatcccggggtcctagaacgtacttcgaggtcgggcggtcgggtctaggggaactagtcttcactctcaccatcagcagccgtggcggacagaagatgtgtgttatacgtggtcagctagtattntcgttactcgtctacgtagttcggcgaagggtaacaagcgttaggacgtagttcgcacgtaacgtggtcgctgacctaacttaacgtc

SEQ ID NO: 338158 - DNA, 630 bp, Homo sapiens
  misc_feature: GZ8MTXP01CYM72.38.20.B09.1.454.CMB.2.raw
  modified_base (243)..(243): a, c, t, g, unknown or other
  misc_feature (243)..(243): n is a, c, g, or t
  modified_base (329)..(329): a, c, t, g, unknown or other
  misc_feature (329)..(329): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggagggccacgatcaactgcaagtccagccggagttgtttanacaactacaaagaataagtagttcttagcttaggtaccagacaagaaaccacgacagccctactaagctcgtccttacgtttacgngggaccccttcgtaaccccgggggaatcccgggggtaccctgaaccggtacttcggaggtcggggccgggtcgggtacgtggggaactaggtactttccactcctacaacatcagcacgccgtggcgggactaggaagtagtggttggtacggtttattacgtggtacgagtactagttattagttcgttaccttacctctacgttaggtttcggaccggtaacgggggtaacaaggtcgttaggaacgtcgttacggcgaacggtaacgtgggtcggacgtcggacctaacccgttgtcg

SEQ ID NO: 338159 - DNA, 582 bp, Homo sapiens
  misc_feature: GZ8MTXP01DOGVE.38.20.B09.1.454.CMB.2.raw
  modified_base (244)..(244): a, c, t, g, unknown or other
  misc_feature (244)..(244): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (475)..(475): a, c, t, g, unknown or other
  misc_feature (475)..(475): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacgatcaactgcaagtccagccggtagttgtttanaacaactacaagtaataagtgttacttagcttaggtaccagacaagaaaccacgacagccctactaagctcgtcttcgtttacgcgggtcccttacggtacccggggtagttccccgggggtcctagaaccgtacttcgagggtggccgggtcgggtactgggctagtactttcactcacacatcagcacgcctggcgggntagaagntggtagtcgtttatactggtacngtactagttattatgttactctctacgttaggttcggcggtaacgggacaggtcgttaggagtcttaccgcttaacggaacgtggccggtctcgactccgttgttcc

SEQ ID NO: 338160 - DNA, 637 bp, Homo sapiens
  misc_feature: GZ8MTXP01EEFK7.38.20.B09.1.454.CMB.2.raw
  modified_base (248)..(248): a, c, t, g, unknown or other
  misc_feature (248)..(248): n is a, c, g, or t
  modified_base (618)..(618): a, c, t, g, unknown or other
  misc_feature (618)..(618): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggacgggccacgatcaactgacaagtccagccggtagttgttttaanacaactaccaaagtaataagtattacttagcttaggtaaccagacaacgaaaccacgacacgaccctacctaagctgtccttacgtttacgtcggggcccttaccggaaccccggggtacgttccccgggggtacctagaacgtacttcgaggtcgggcggtcgggtacgtaggggaacaggtactttccacttctacacctatcagcacgccgtggcgggtacgtagaagtagtggtcgggttacgtttagttacgtgggttacgagtactaagttattagttacgttacctccttacgtacgttacggtttcgggaccggtaacggggacgaaggtcgttaggagacgttcgcgacgaacgtggtgcncgttactaaccgttgttcc

SEQ ID NO: 338161 - DNA, 647 bp, Homo sapiens
  misc_feature: GZ8MTXP01A5UCU.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccagatcaactgacaagtccagccggtagttgtttanacaactacaaagtaataagtagttcttagcttaggtaccagacaacgaaaccacgacacgcctactaagctcgtccttacgtttacgcggtccctacgtaacccgggggaacgttcccgggggtacctaggaaccgtacttccggaggtcggggccggggtcgggtacgtaggggaactagttactttcccgaacctccgtaccacctatccaagcgacgccgtggcgggtactagaagtgtggtgggtcgtttatacgtggtcaggtactagttattagtcgttacctcctacgtacgttaggtttcggaccggtaacggggaccttaaggtcgttagggagtacgttaccggcttaacggtaacgtcggtaacggtccgtcggacctaaccttaacgttccg

SEQ ID NO: 338162 - DNA, 607 bp, Homo sapiens
  misc_feature: GZ8MTXP01DQVWK.38.20.B09.1.454.CMB.2.raw
  modified_base (236)..(236): a, c, t, g, unknown or other
  misc_feature (236)..(236): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagcgatgtttanacaactcaagaatagattcttagctggtacagcaagaaaccacgacagccctactaagctgacttcgtttaacgtcggcccttaccgtaacccggggtaagttccccgggggtacctagaaacgtacttccgaggtcggggcggtcgggttacctgggcagtatttcactcctcgaccatcagcacgctcgcgggctagaagagtggttcgtcggtttaatttaccgtggtacgtaacggactaacgttatttaattacgtttaccttaccctcgtaccgtaaggttttcggaccggaagggtaacccaaaggtcgttaggacgtacgttcgcttaaccgaagtggtcggtactgcctaacgttaattccg

SEQ ID NO: 338163 - DNA, 608 bp, Homo sapiens
  misc_feature: GZ8MTXP01C7XF4.38.20.B09.1.454.CMB.2.raw
  modified_base (462)..(462): a, c, t, g, unknown or other
  misc_feature (462)..(462): n is a, c, g, or t
  modified_base (512)..(512): a, c, t, g, unknown or other
  misc_feature (512)..(512): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacgatcaactgacaacgtccaggccggtagttgtttaacaacaactaccaaagaaataagtagtttacttagcttaggtaccagacaacgaaaccacgacacgaccctactaagctgcttcgttacgtcgggtccctaccgtaacccgggtacttcccgggggtacctaggaacgtacttcgaggtcgggccgggcgggtactagggcagtactttcactcactacatcagcacgcctggcgggactagaagngtggtcggtacgtttatcgtggtcagtctagttattagtcgttactcctntacgttaggtttcggaccggtaaggggaccaaggtcgttagggtaacgacgttccgcgaacgtaacgtagggtcgctacgactaaccgttgttccg

SEQ ID NO: 338164 - DNA, 692 bp, Homo sapiens
  misc_feature: GZ8MTXP01AINMW.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggtagttgtttanacaactcaaagaataagattcttagcttaggaccagacaacgaaaccacgacacgccctactaagctgcttacggtttacgtcggggtccctccggtaaccccggggaacgttccccgggggtacctaggaacgtctttccggaggtcgggcggggtcgggttcgtacggggaactaggtactttaccgacctcctaccgaacctactaccgacgcgacgccgtcggacgggtacgtaggaacgtagtgggttcgggttacgggttttaacttacgttggggtacgtaaggtaccgttaagtttatttaacgttcgtttaaccgttaccttaccgtacgttacggttttaccgggaccggtaacggggtaacccgaaagggtcgttagggaacgtacgttccggcgaaccggtaacgtggtcggcgtacgacctaaccgttaacttcg

SEQ ID NO: 338165 - DNA, 631 bp, Homo sapiens
  misc_feature: GZ8MTXP01BOE1N.38.20.B09.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (502)..(502): a, c, t, g, unknown or other
  misc_feature (502)..(502): n is a, c, g, or t
  modified_base (616)..(616): a, c, t, g, unknown or other
  misc_feature (616)..(616): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgagacgggccagatcaatgacaagtccaggccggtagttgtttaanacaactacaaagaataagnttcttagcttaggtaccagacaagaaaccacgacacgcctacctaagctcgtccttcgtttaacgtcgggacccttaccgtaaccccggggaacgttcccgggggtccctaggaaaccgtactttccgagggtcggccgggtacgggtctagggaacagtactttccgactcgtaccactatccaagcacgccgtggcggactaggaaagtgtggtagggtacggttttattaacgngggttacgagtactagttagttacgttcgttaaccttcgtacctaagttacggtttcggaacccgtaaggggacccaagtcgttaggagcttcgcgaacgtaactgaaggtccngacctcgttaattcg

SEQ ID NO: 338166 - DNA, 619 bp, Homo sapiens
  misc_feature: GZ8MTXP01BOXSD.38.20.B09.1.454.CMB.2.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactccaaagaataagagttcttagcttggtaccagcaagaaaccacgacagcctacctaagctgctcgtttacngggccctcgtacccgggatcccggggtcctagacgtcttcaggtggcggcggtctggggaacngatttcactctcactatcagcacgccgtgccgggtctagaagagttggttgggtcgtttaagttacgtgggtacaggtactaaggttattagttcgtttaccgtacccttcgtaacgttacggttttacgggcccggtaacgggggtaacccttaaaggtccggttagggacgtacgttaccggaccgttaacggtaaaccgtcgggttcgggccgtcggacctaaccgttaacttccg

SEQ ID NO: 338167 - DNA, 715 bp, Homo sapiens
  misc_feature: GZ8MTXP01AH0Q2.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcagggcagcaagatggtgttgcagacccaggtcttcatttctctgttgctctggatctctgttactacaggtgcctacgggacatcgtgatgacccagtctccagacctccctggctgtgtctcgtgggcgaggagggccacgatcaactgacaagtccagccggtagttgttttanacactacaagaataagtagttcttagcttaggaccagcaagaaaccacgactagcctacctaagcctgtccttacgtttacgtcgggtccctacgtacccgggaacttccggggtccctaggaaccgtacgttccgaggtcggggccgggcgggttaaccgtaggggaactagtacgtttaccactcctacaaccctatacgacgtccgacgtcccgtggaccgggacgtaggtaaggtagttacgggttacgggttacggtttaacgttacgtacggggtacgtacggtaccgtaaggttaagtttacttacgtttaccttacccttaccgttaacgttacgggttttaccgggacccgggtaacggggtaaccttaacgggtaccgttacgggaagtaccgttaccggttaccgaacggtaacgttcgggtaacggtaccgttacggacccgaaccgttaacgttcccg

SEQ ID NO: 338168 - DNA, 593 bp, Homo sapiens
  misc_feature: GZ8MTXP01EBOVP.38.20.B09.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgagacgggccaaccatcaactgacaagtccagccagtagttctttgtcagctacaaagaatatgagttcgtagcttaggtaccagacaagaaancacgacacgtcccctaagtnctatatttatgtcatctacgtcgggtcgtcccggggtcctgaccctatcagcggnaggcgatcgtagggactagtattcactctacacatacagcacgcctgacaagactagggaaagtagttggtacggtacttaagtttaacttacgtagtactaagactaaattagttaagttcggttacgttccgttcggtaccttccgttaccggtttcggggaccggggtaacgggtaacccggtaaagggtcgggaagttacgtaaccgaaaggtaacccggg

SEQ ID NO: 338169 - DNA, 556 bp, Homo sapiens
  misc_feature: GZ8MTXP01EMVZV.38.20.B09.1.454.CMB.2.raw
  modified_base (239)..(239): a, c, t, g, unknown or other
  misc_feature (239)..(239): n is a, c, g, or t
  modified_base (552)..(552): a, c, t, g, unknown or other
  misc_feature (552)..(552): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagacagaaaccacgacagccctactaagctgcttcgtttactgggccctcgtacccgggatcccggggtcctagaacgtacttcgagtgggccggcgggtcgtgggaactagtatttccactctcacatcagcagcctggcggacgtagaagagtggtggtacggtttagttactggtctaggtctagttattatcgttactcctctacttagtttcggcggtaacgggaacaaggcgttggagtacttcgcacgaactggtggctcgactaaccgttnttcg

SEQ ID NO: 338170 - DNA, 586 bp, Homo sapiens
  misc_feature: GZ8MTXP01DT8OM.38.20.B09.1.454.CMB.2.raw
  modified_base (247)..(247): a, c, t, g, unknown or other
  misc_feature (247)..(247): n is a, c, g, or t
  modified_base (359)..(359): a, c, t, g, unknown or other
  misc_feature (359)..(359): n is a, c, g, or t
  modified_base (586)..(586): a, c, t, g, unknown or other
  misc_feature (586)..(586): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtggggcgaggacgggccacgatcaactgacaagtccagccggtagttgtttanacaactacaaagaataagtagttcttagcttaggtaccagacaacgaaaccacgacacgccctactaagctgcttcgttacgcggccctacgtacccgggatccgggtaccngaacgtctcgaggtcggcggcgggtcagggcagtactttcactcacaccatcagcacgccgtaggccgggatagaagtgtcggtggtacgtttaatcgtggtacgaggtctagtagtcgatcgaggtcgtccctccggatcccgaaccgttcgggaccggaagggacctaacggacgttacggaacaaaacgtaacgacgtggtacggcttcggaaccttaaccgtn

SEQ ID NO: 338171 - DNA, 619 bp, Homo sapiens
  misc_feature: GZ8MTXP01BTCOQ.38.20.B09.1.454.CMB.2.raw
  modified_base (242)..(242): a, c, t, g, unknown or other
  misc_feature (242)..(242): n is a, c, g, or t
  modified_base (548)..(548): a, c, t, g, unknown or other
  misc_feature (548)..(548): n is a, c, g, or t
  modified_base (581)..(581): a, c, t, g, unknown or other
  misc_feature (581)..(581): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctgtggggcgaggagggccacgatcaactgcaagtccagcgtagttgtttanacaactacaagaataagtattcttagcttaggaccagacaagaaaccagacacgcctacctaagctcgcttacgtttacgcgggtccctacggtaccccgggagttcccgggggaccctaggaaacgtacgttcgagggttcgggaccgggtcggggtaccgtaggggaacctaggtactttcccaacgttcctaccaacccgtaatccgaagccgacgtcccgtacggcgggtactaggaaagtgtcggttgggtaccgtttattaccgtggtacgagtactagttaacttagtacgttactctntacgttagttcgacgaagggacagtcgaggacncgttcgcagtaactggtcgctgacctaaccgttgtccg

SEQ ID NO: 338172 - DNA, 596 bp, Homo sapiens
  misc_feature: GZ8MTXP01CKHRY.38.20.B09.1.454.CMB.2.raw
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (562)..(562): a, c, t, g, unknown or other
  misc_feature (562)..(562): n is a, c, g, or t
  modified_base (593)..(593): a, c, t, g, unknown or other
  misc_feature (593)..(593): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggtattgtttanacaactacaaagaataagattnttagcttggaccagacaagaaaccacgacacgcctctaagctagcttcgtttacgtgggacccttaccgtacccgggggaattccccgggggtaccctagaaccgtacttcgaggtcgggcgggcgggtacgtgggaactagtaacttttccgactcctacaacccatacagcacgccgtggcgggactaggaagtagtgtggtacggtttattacgtggtacaggtactaagttattaatcgttactacctctacgtagtttcggcgtaacggggaaccaaagcgttggacggtancgcgacgtaacgtgtcgctcgactaacgttntcg

SEQ ID NO: 338173 - DNA, 645 bp, Homo sapiens
  misc_feature: GZ8MTXP01BXGQX.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagcgagttgtttanacactaccaagaataagtagttcttagcttaggtaccagacaagaaaccacgtacacgccctacctaagctgtcttcgttactcgggcctcgtaacccgggattcccgggggacctaggaacgtacttcgaggtcgggcggtccgggtacgtcggggaactagtactttccgaactctacaaccatcacgcacgccgtgcggtactggaaagtgtaggtcgggttacggtttattaccgttaggggtactaggtacgtaagtttaattacgttcgtttaacctccttacgtaacgttaacggttttcggacccgggtaaacggggaacccttaaggaccgttagggaaaggtcttaccgggcaacggtaacgtgggttcggcttcgacctaacccaagtttcccg

SEQ ID NO: 338174 - DNA, 649 bp, Homo sapiens
  misc_feature: GZ8MTXP01BCULT.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccagatcaactgacaagtccagccggagttgttttanacaactccaaagaataagagttcttagcttaggtaccagacaagaaaccacgacagccctactaagctgtccttacgtttacgcgggacccttcgtaccccgggggtaattccccgggggtcctaggaaccgtacgttccgaggtggggacccgggcggggtaactaggggaacctagggtaacttttcccacttccgtacaaccctatacacgcacgccgtggccgggacgtagaagtagtacggtggtacggtttagttacgtgggtacaggtactagtattatcgttactccgtctacgtagtttcggccgaacggggtacccaaaggcgttagggtacgtacgttaccgacgttaccggtaactcgggttaacggccgtcggacctaaccgttaacgtttccg

SEQ ID NO: 338175 - DNA, 515 bp, Homo sapiens
  misc_feature: GZ8MTXP01BTUCZ.38.20.B09.1.454.CMB.2.raw
  modified_base (238)..(238): a, c, t, g, unknown or other
  misc_feature (238)..(238): n is a, c, g, or t
  modified_base (512)..(512): a, c, t, g, unknown or other
  misc_feature (512)..(512): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcaagaaaccacgacagcctctaagctgctcgtttactgggccctcgtacccgggatccgggtcctgacgattcaggtggcggcggtctgggcagtatttcactctcaccatcagcagcctgcgggctgaagatggtgtcggtttattactggtcagcagttattatgttactcctctactagtttcggcgtaagggacagcgttggagacttcgcacgaactgtggctcgctaaccgntcg

SEQ ID NO: 338176 - DNA, 614 bp, Homo sapiens
  misc_feature: GZ8MTXP01C0EEH.38.20.B09.1.454.CMB.2.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctgtggggcgaggacgggccacgatcaactgacaagtccagccggtagttgtttanacaactacaagaataagtagttcttagcttaggtaccagacaagaaaccacganacgcctacaagctgcttcgttacncggtccctacgtacccgggatcccgggggtaccnggaacgtcttcggaggtcgggcgggtcgggtctagggcagtactttcactctacacatcagcacgcgtgcgggctaggagagtggtgtacgtttattacgtgtacgagtactagttattagtacgttacctacctcgtacgttaggtttcggaccggtaaacggggtaccgaaggtaccgttaggtaacgtcgttaccggttcgaaaccggtaacgttcggtcggtacgtccggttacctaacccgttcgtttcccg

SEQ ID NO: 338177 - DNA, 624 bp, Homo sapiens
  misc_feature: GZ8MTXP01CDBXN.38.20.B09.1.454.CMB.2.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggtagttgtttaanacaactccaaagaataagtagttcttagcttaggtaccagacaagaaaccacgacacgcctactaagctgcttcgtttacgngggtaccctcgtacccggggtatcccgggggtacctagaacgtacttccgaggtcgggccggtcggggtacctggggaaccaggtactttccactcctaccgaacctatccagccacgccgtggcgggctagaagtgtggtggtagtttattactggtcagtctagttattagttcgttactcctctacgtcggtttcgccgtaacggggaaccttaaggtcgttagggaacgtcgttaccggccgaacggtaacgtcgggtcggccgttcggacccgtaacccgttaagttttcccg

SEQ ID NO: 338178 - DNA, 540 bp, Homo sapiens
  misc_feature: GZ8MTXP01E0GTI.38.20.B09.1.454.CMB.2.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagngttcttagcttggtaccagcagaaaccacgacagcctcctaagctgcttcgtttacngggccctctacccgggatccggggtcctgaacgattcagtggcggcggtngggaanagatttcactctcaccatcagcagcctgcggcngagatgtggtcgttattacnggtcaggtcagtatttagtcgtttacacctctactagtttcggccgaagggggtacaaaggtcagggtagaacgttcgcaacccggtaatgtcgggacttcgactaacccgaatttcg

SEQ ID NO: 338179 - DNA, 565 bp, Homo sapiens
  misc_feature: GZ8MTXP01B06C5.38.20.B09.1.454.CMB.2.raw
  modified_base (240)..(240): a, c, t, g, unknown or other
  misc_feature (240)..(240): n is a, c, g, or t
  modified_base (416)..(416): a, c, t, g, unknown or other
  misc_feature (416)..(416): n is a, c, g, or t
  modified_base (534)..(534): a, c, t, g, unknown or other
  misc_feature (534)..(534): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagagttcttagcttggtaccagcaagaaaccacgacagccctactaagctgcttcgtttacgtcgggcccttcgtaacccgggatcccgggggtccctaggaacgtacttcgaggtcgggccgggtcggggtactagggaacagtactttcactctcaaccntcagcacgcctggcgggtcgaggaagtagtggtggtacggtttattacgttggtcgagtctagttattagttcgttactcctctactagtttcggcgtaagggaccaggcgttggagngttcgcacgaatggtgctgctaaccttgtcg

SEQ ID NO: 338180 - DNA, 628 bp, Homo sapiens
  misc_feature: GZ8MTXP01DL82O.38.20.B09.1.454.CMB.2.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggagggccacgatcaactgcaagtccagccggagttgtttanacaactcaagaataagagttcttagcttaggtaccagacaagaaaccacgacagccctctaagctgcttcgtttacncgggtcccttaccgtacccggggatcccgggggtccctagaaccgtacttcgaggtcgggcggtcgggtactggggaacagtactttcgactctacaccatcagcacgctggcggactagaagtagtggttcggtacggtttattacgtgggtactagtactaagttaatttagttgtttaccttacctcgtacgttacggttttcgggaccggtaacgggggtaaccgaaggtccgttagggaacgtacgttaccggacgaacggtaaccgttggtcggtcgtcgaccgtaaccgttaacgtttccg

SEQ ID NO: 338181 - DNA, 627 bp, Homo sapiens
  misc_feature: GZ8MTXP01CA31W.38.20.B09.1.454.CMB.2.raw
  modified_base (248)..(248): a, c, t, g, unknown or other
  misc_feature (248)..(248): n is a, c, g, or t
  modified_base (590)..(590): a, c, t, g, unknown or other
  misc_feature (590)..(590): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgaggacgggccaacgatcaactgacaagtccagccggtagttgtttanacaactaccaaagtaataagtagttcttagcttaggtaccagacaagaaaccacgacacgccctactaagctgccttcgtttacgcgggtcccttaccggtaacccgggtactccccggggtacctaggaaccgtacttccgaggttcggggaccgggtcgggtacgtacggggaactacggttaacttttcccaacttccctaccaaccctataccgacgcacgccgtcggcgggtacgtaggaagtagtggtaggttacggtttattacgtggtactagtacgtagttattattcgttactctctacgtggtttcgcgtaacgggacagtcgttgacgtnttcgcgacgtaactggtcgctcgacctcgaacttccg

SEQ ID NO: 338182 - DNA, 596 bp, Homo sapiens
  misc_feature: GZ8MTXP01DMCUD.38.20.B09.1.454.CMB.2.raw
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaactgcaagtccagccggagttgtttanaacaactccaaagaataagngttacttagcttggtaccagacaagaaaccacgacagcctaccaagctcgtctcgtttactcggggcccttcgtaaccccggggaattccccgggggtccctggaaccgtatttccgaggttcggggcggtcggggtcctggggaaccagtaactttcaacctctcaaccatcagcagctgcggctgagatgtgtcgtttaattcgtgtacagctaagtattattcgttactaccttctacgttaaagttttcggaccggtaacggggaaccgaaaggtccgttagggagtacgttacgcgaacgtaacgtggtggcgtcgcctaacgaactttccg

SEQ ID NO: 338183 - DNA, 693 bp, Homo sapiens
  misc_feature: GZ8MTXP01CWU1H.38.20.B09.1.454.CMB.2.raw
  modified_base (247)..(247): a, c, t, g, unknown or other
  misc_feature (247)..(247): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctcctggctgtgtctcgtggggcgaggacgggccacgatcaactgacaagtccagccggtagttgtttanacaactacaaagtaataagagttcttagcttaggtaccagacaacgaaaccacgacacgcctacaagctgtccttacgtttacgcggtcccttacggtaaccccggggtatccccgggggtaccctaggaaaccgtacgttaccggaggtcggggaccgggtcggggttactacggggaacctaagggtactttacccgactcctaccaaccctatcaacgccgaacgcccgtgggacccggggtattagggaaagtgttcggttagggttaccgtttaattaccgtggggttacgaaggtctaaggttaatttacttacgtttaacctcccttacgtaacgttcgggtttacggacccgggtaaggggaaaccaagggtcgttagggtacgacgttaccgcgttaaccgtaaggtcggtcggcctacgcctaaccgttctttccg

SEQ ID NO: 338184 - DNA, 699 bp, Homo sapiens
  misc_feature: GZ8MTXP01B6V74.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggtattgtttanacaactccaaagaataagagttcttagcttggtaccagacaacgaaaccacgacacgaccctacctaaacgctcgtccttaccgtttaacgtcgggtccctaccgtaccccgggggtaacgtcccggggttacccgtacgtaacgtacttcgtaggtcgggccgggtcggggtacgtacgggaacgtagtacgtttccaccgtctaccgaccagtaccagtccgacgtccgtcggcgggtactaggaagtagtggttcgggtacggttttattacgtgggtactaggtactagttatttacgttacgtttaccttccttacgtaccgttaggttttaccgggcccggaaacgggggtacccttaaagggtccgttagggtaaacggccgttcggaccgttaaccggtaacggttcggtcgggtacccttcggacccgtaacccttaacgtttcccg

SEQ ID NO: 338185 - DNA, 583 bp, Homo sapiens
  misc_feature: GZ8MTXP01BBPUK.38.20.B09.1.454.CMB.2.raw
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctcagactccctggctgtgtctcgtgggcgagagggccagatcaactgacaagtccagccggtagttgtttanacaactacaagaataagtagttcttagcttggtacccagacaagaaaccacgacagccctacctaagctgcttcgtttacnggccctcgtaccgggatccgggtccngaacnttcgagtggcggcggtnagggcagtactttcactctacaccatcagcagccgtgcgggactaggaagagtggtggtacggtttattacgtggtcagtcctaagttattatcgttactccgtctacgttagttttcggccgtaacggggaccgttaaggtccgttagggagtacgttccggcgaacggtaaccgtggtaacggtcgtcggaccgtaaccttaacgtttccg

SEQ ID NO: 338186 - DNA, 706 bp, Homo sapiens
  misc_feature: GZ8MTXP01CWCUB.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgaggacgggccacgatcaactgcaagtccagccggtagttgtttanacaactacaaagaataagtagttcttagcttaggaccagacaagaaaccacgacacgccctacctaagctcgtccttacgtttacgtcggaccccttacgtaaccccgggaacgttcccgggggtaccctaggaaccgtacttccggaggtcggggccggccggggttaccgtaggggaacctaaggtactttaccaccttccgtaccacctatcgacgcgacggtccgtggccgggacgtaggaagtacgttaggttcgggttacggttttattaccgttgggtaacgtaggtacctaaggttaactttaagttcgtttaaccttcccgttactacgttaggtttccgggaccgggtaacggggaacccgttaaggtacgttagggtaacgtcgttacccgcgttaaccggtaacgttcggtcgggtcgtacggttacccgtaaccgttaacgtttcccg

SEQ ID NO: 338187 - DNA, 613 bp, Homo sapiens
  misc_feature: GZ8MTXP01EXEMW.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaagtccagccggtagtgtttanacaactccaagaataagagttcttagcttaggtaccagacaagaaaccacgacagcctctaagctgcttcgtttacgcggccctcgtacccgggatcccgggtcctagaacgacttcgaggtggcggcggtactgggcagtactttcactctcaccatcgagcacgccgtgcgggtactagaagtagtggtcggtacggtttattacgtgggtacagtactagttattagtcgtttacctaccttacgtacgttacggttttcgggacccggtaacggggtaaccgaaaggtccgttagggtaacgtacgttaccggaccgttaaccggtaacgtcggttaacggcgttacggacctaaccgttaattccg

SEQ ID NO: 338188 - DNA, 570 bp, Homo sapiens
  misc_feature: GZ8MTXP01A3FB8.38.20.B09.1.454.CMB.2.raw
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (430)..(430): a, c, t, g, unknown or other
  misc_feature (430)..(430): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggatgtttaanacaactcaaagaataagtagttcttagcttaggtaccagacaacgaaaccncgacacgcctcctaaagctgcttacgtttacngggccctacgtacccgggatccggggtccagaacgacttcgagtggcggcggtactgggaacagtctttcgactctcaccatcagccagcctggcggctagaagngtggtggtacgtttattcgaggtcagctagttattagttcgttactcctcgtacgttaggtttcggaccgaagggggtaacccaaggtcgttggagtcttcgcacgtaacgtggtcgggctacgcctaacccgttgtccg

SEQ ID NO: 338189 - DNA, 626 bp, Homo sapiens
  misc_feature: GZ8MTXP01EC7SY.38.20.B09.1.454.CMB.2.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
tcagtcgatcacgtcacgaccggtgctcgatttagtgtagtgtgaagggggagctacaacaggcaggcaggggcagcaagatggtgttgcagacccaggtcttcattttctctgttgctctggatctctgttactacaggtgcctacggggacatcgtgatgacccagtctccagactccctggctgtgtctcgtgggcgagacgggccacgatcaactgcaagtccagccggtagttgttttanacaactacaagaataagngttcttagcttaggtaccagacaacgaaaccacgacacgccctacctaagcttcgtccgttcgtttacgtcgggtcccttaccggtaccccggggaacgttccccggggtacctagaaccgtacttcgaggtcgggcggtcgggtacgtagggaacagtatttcccactcctacacctatcgagcacgccgtggcgggtcgtagaagtagtggttgggtacgtttattacgtcggtcgtagtctaagttattagttcgtttacctccttcgtacgttacggtttcggccggtaacgggtaaccaaggtcgttaggacgtacgttacgcgacgtaacgtggtcgctcgacctaacgttcttccg

SEQ ID NO: 338190 - DNA, 639 bp, Homo sapiens
  misc_feature: GZ8MTXP01AXKSH.38.20.B09.1.454.CMB.2.raw
  modified_base (245)..(245): a, c, t, g, unknown or other
  misc_feature (245)..(245): n is a, c, g, or t
  modified_base (596)..(596): a, c, t, g, unknown or other
  misc_feature (596)..(596): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggagggccacgatcaactgacaagtccagccggtagttgtttanacaactacaagaataagagttcttagcttaggtacagcaacgaaaccacgacagcctactaagctgcttacgttacgtcggtccctacggtaccgggatcccggggtcctagacgtcttcgagtcggcggcggtcgtagggcagtactttcgactcgtacaaccgtataccagccgacgtccgtcgggccgggtacgtaggaaggtacgtggttacgggtacggttttaagttaccggttcggttacgaacggtccgtaagtttaagttacgttacgtttaccgtaccgttaccgtaaccgttacggttttccgggaacgtaacgggggtaccaaggtcgttaggagtacnccggacgacgtaacgtggtaacgcgtgaccaaccgttgttccg

SEQ ID NO: 338191 - DNA, 601 bp, Homo sapiens
  misc_feature: GZ8MTXP01DPYPF.38.20.B09.1.454.CMB.2.raw
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgagacgggccacgatcaactgacaagtccagccggtagttgtttanacaactcaaagaataagagttcttagcttggtaccagacaagaaaccacgacacgcctactaagctgcttacgtttacgngggtccctaccgtacccggggaacttcccgggggtcctaggtaaccgtagttccggaggttcggggccggtcggggtacctagggaactaggtactttccactccacaccatcagcagcctggcggntagaagtntggtgtacggtttatacgtggtactagtctaagttattagtcgttacttcctacgtaccgttaggtttcgaccggaagggtaccaagtcgaggagtattccgcacggtaatcggtcggtctcgacctcgttaacgtttccg

SEQ ID NO: 338192 - DNA, 621 bp, Homo sapiens
  misc_feature: GZ8MTXP01BICOP.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagttgtttanacaactacaaagtaataagtagttcttagcttaggtaccagacaagaaaccacgacacgcctcctaagctgcttcgtttactcgggccctaccgtacccgggatcccggggtcctaggacgtacttcgaggtgggccgggcggtactgggcagtactttcactctacaccatcagcacgcgtggcgggactagaagtagtggttcgggtacggtttattacgtgggtacgtagtaccgtaagttatttacgttcgttaccttcccttaccgtacgttacggttttcgggccgtaacgggggacccttaaagggccgttagggacgtacgttccggcgaacgtaacgtggtcgggctacggacctaaccgttaacttccg

SEQ ID NO: 338193 - DNA, 629 bp, Homo sapiens
  misc_feature: GZ8MTXP01APK3W.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgagagggccacgatcaactgacaagtccagcggtagttgtttanacaactacaagaataagtgttcttagcttaggaccagacaagaaaccacgacacgccctactaagctgtcttacgtttacgtcgggtccctaccggtacccggggtaactcccgggggtaccctaggaacgtcttcgaggtcgggccgggtcgggtctaggggaactagtactttccaccgtctaccactatacgacgcacgccgtggcgggactaggaacgtagtggtcgggttcgtttattacgtggtacagtctagttattagtcgttacctcgtctacgttggttcggaccggtaagggtaccaggtcgttagggaacgtacgttaccggcgttaaccggtaaggtcggtcggtcgtacggacctaaccgttaacgtttccg

SEQ ID NO: 338194 - DNA, 653 bp, Homo sapiens
  misc_feature: GZ8MTXP01DP31Z.38.20.B09.1.454.CMB.2.raw
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggacgggccacgatcaactgacaagtccagcgagttnttanacactacaagaatagngttcttagctgtaccagacaacgaaaccngacacgccctactaagctgtcttcgttacgtcggtcccctacggtaacccggggaacgttccccgggggtacctaggaaccgtacttccgaggtcgggccgggtcgggtaccgtgggaacctagtctttaccaccttcctacacctatccagcacgccgtcggacgggtacgtagtaagtcgtggttcgggttacgtttattacgtggtacgagtactaagttacttagttcgttacttccgtctaacgttaggtttcggacggtaacgggggacccttaaaggtcgttacgggtaagtacgttaccggacgttaaccggtaacgttgggtaaccggtcgtacggttacctaaccgttaacttccg

SEQ ID NO: 338195 - DNA, 635 bp, Homo sapiens
  misc_feature: GZ8MTXP01D75ZZ.38.20.B09.1.454.CMB.2.raw
  modified_base (251)..(251): a, c, t, g, unknown or other
  misc_feature (251)..(251): n is a, c, g, or t
  modified_base (334)..(334): a, c, t, g, unknown or other
  misc_feature (334)..(334): n is a, c, g, or t
  modified_base (453)..(453): a, c, t, g, unknown or other
  misc_feature (453)..(453): n is a, c, g, or t
  modified_base (510)..(510): a, c, t, g, unknown or other
  misc_feature (510)..(510): n is a, c, g, or t
  modified_base (630)..(630): a, c, t, g, unknown or other
  misc_feature (630)..(630): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagactcccgtggctgtgtctcgtggggcgaggacgggccacgatacaactgacaacgtccaggccggtagttgtttanaacaactacaaagaataagagttcttagcttaggaccagacaagaaaccacgacagccctactaagctcgtcttcgtttacgngggtacccctaccggtaacccggggtaacgttccccgggggtacctaggaaccgtacgttccgagggtcgggccgggccgggtaactggggaactagtactttccactctacacatacngcacgcgtggcggacgtagaagtagtggtaggtacgtttatacgtcggtacgacgtntaagttattattcgtttactcctgtaccgttaggtttacggcggtaacgggtaacgaacggcgttggaacgtacgttaccgcgaacgtaacgtggtaacggtcgtacgacctaaccgttnttccg

SEQ ID NO: 338196 - DNA, 719 bp, Homo sapiens
  misc_feature: GZ8MTXP01C3476.38.20.B09.1.454.CMB.2.raw
  modified_base (249)..(249): a, c, t, g, unknown or other
  misc_feature (249)..(249): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctcccgtggctgtgtctcgtgggcgaggacgggccacgatcaactgacaacgtccagccggtagttgtttanaccaactaccaaagtaactaagtagttcttagcttaggtaccagacaacgaaaccacgacacgccctacgtaacgctcgtccgttacgttacgtcggtacccttaccggtaacccggggtacgttcccggggtacctacgaacgtaacgttcgtaaggtcgggccgggcggtacgtacgggaacgtatacgttctaccgtctaccactactcagaccgagccgtgcgggacgttacggaaggtacgttacggtacgggttacggtttaaacgtttccgttaggggtacctaacgggtcttaagggttaactttacgtttccgtttaacgttccccgttactaacggttaccggttttaccggcggtaaccggggaaccttaggtaccggttagtaaacgggtcttacccggacgttaccgttaacggtcggtaacggttaccgcggacccgttaaccttgttttccccgg

SEQ ID NO: 338197 - DNA, 545 bp, Homo sapiens
  misc_feature: GZ8MTXP01BK7DJ.38.20.B09.1.454.CMB.2.raw
  modified_base (239)..(239): a, c, t, g, unknown or other
  misc_feature (239)..(239): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggatgtttanacaactcaagaatagagttcttagcttggaccagcaagaaaccacgacacgcctacctaagctgcttcgtttacgtggccctcgtacccgggatccggggtccctagaacgacttcgagtgggcggcgggtactgggcagtacttcactctcaccatcagcagccgtgcgggtcgtagagagtgtggtcgtttattacgtggtcagtctagtattagttcgttactcctctacgtagtttcggcgaagggtacaggtcgttggagtgttacgcacgtaacgtggtcgacgtgacctcgttaattcg

SEQ ID NO: 338198 - DNA, 600 bp, Homo sapiens
  misc_feature: GZ8MTXP01B6EVQ.38.20.B09.1.454.CMB.2.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagttgtttanacaactcaaagaataagagttcttagcttaggaccagcaagaaaccacgacagcctaccaagctgctcgtttacgngggccctcgtaacccgggatcccgggggtaccctaggaaaccgtattcgaggtcgggccgggtcgggtactggggaactaggtatttccaacctctacaaccatcacgcacgccgtcggcgggacgtagaagtagtggtgggtcggtttagttacgtgggtcgtagtctaagttattattcgttaactcctactaccgtacgtttcgggccgtaacggggaacccaaaggtcgttagggacgtacgttcgcgacgaacgtggtcgctcgcaacccgttgtccg

SEQ ID NO: 338199 - DNA, 654 bp, Homo sapiens
  misc_feature: GZ8MTXP01AYC42.38.20.B09.1.454.CMB.2.raw
  modified_base (257)..(257): a, c, t, g, unknown or other
  misc_feature (257)..(257): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtcgccgtacggggacatcgtgatcgacccagtcctccagacctcccgtggctgtgtctcgtggggcgaggacgggccacgatacaactgacaacgtccgagccggtagttgttttaanaccaactacaaagtaataagtagtttacttagcgttacggaaccagacaacgaaaccacgacacgcctactaagctcgtcttcgttacgcggtccctaccggtacccgggtacgtccccgggtactaggaacgtcttcgagggtcggccgggcggtacgacgggctaggtctttccaccgtcctaccacctagtccacgtccgacgtcccgtgggccgggtactaggtaagtaggttcgggtacggtttacgtttacgttaccgtggtacgacgttactaagtttattacgttcgttaccttccgtattacggttaggttaccggaccggtaacgggaaccttaggcgttaggacgtacgttcgacgacgtaagtggcgtctcgacctcgttcttcg

SEQ ID NO: 338200 - DNA, 587 bp, Homo sapiens
  misc_feature: GZ8MTXP01B91HR.38.20.B09.1.454.CMB.2.raw
  modified_base (245)..(245): a, c, t, g, unknown or other
  misc_feature (245)..(245): n is a, c, g, or t
  modified_base (416)..(416): a, c, t, g, unknown or other
  misc_feature (416)..(416): n is a, c, g, or t
  modified_base (554)..(554): a, c, t, g, unknown or other
  misc_feature (554)..(554): n is a, c, g, or t
  modified_base (583)..(583): a, c, t, g, unknown or other
  misc_feature (583)..(583): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggagggccaacgatcaaactgacaagtccagccggattgtttanacactacaagaataagagttcttagctggacagacaagaaaccacgacagacctcctaaagctgtctacgtttaacgtcgggtcccttaccgtaaccccggggtaaacgttcccgggggtaccctagaaacgtaacttcgaacggtggggcggcggggtccgtacgggaanacgtaatttcactctaccaccatacagcacgccgtgcggggatagaagatgtggtacggtttattacgtgggtatagatagttaatattattactacctctataggtttcgcgaaaggggtaccaaggcttgggaagnttcgacaacgtaagtgcgcgcgactaacncgtc

SEQ ID NO: 338201 - DNA, 687 bp, Homo sapiens
  misc_feature: GZ8MTXP01D1DD7.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgagagggccacgatcaactgcaagtccagccggagttgtttanacaactacaagaataagagttcttagcttggtaccagacaagaaaccacgacagccctacctaagctgtcttcgtttacgtcgggtcccttacgtaccccggggaattccccgggggtaccctaggaaaccgtactttccgaggtcgggccgggtccggggtacgtagggggaaccaaggttacttttacccgaaccttcctaccgaacctatacgaacgccgaacgcccgtcggccgggtacgtagaagtagtggtcgggttacggtttattacgttaggtacgtagtactaagttattagttacgtttaccttcctacgtacgttacggttttacggccggtaacggggtaaccgttaacggtaccgttagggtaacgtacgttaccggacgttaaccggtaaccgttggtcggtcgttcggaccgtaaccgttaacgtttcccg

SEQ ID NO: 338202 - DNA, 652 bp, Homo sapiens
  misc_feature: GZ8MTXP01C1409.38.20.B09.1.454.CMB.2.raw
  modified_base (249)..(249): a, c, t, g, unknown or other
  misc_feature (249)..(249): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtgggcgaggacgggccacgatcaactgacaagtccgagccggtagttgtttanaacaactacaaagtaactagtagttacttagcttaggtaccagacaagaaaccacgacacgacctactaagctgcttcgttacgcggtcccttaccggaccgggtagtcccggggtacctagacgtacttcgaggtcgggccggtcggtcgtagggccagtactttccgactcctacaccgatcgacgtccgacgtccgtggacgggtcgtaggtaagtaggttaggttcgggttacgttttaacgttacgtgggtaccgtagtacgtagttattacgttacgttacttaccgtctacgtcgtttcggaccggtaaggggacccttaaggtcgagggtaacgtacgttccgacgttaccgtaacgtggttcggtaccgtcggaccctaaccgttaacgttccg

SEQ ID NO: 338203 - DNA, 528 bp, Homo sapiens
  misc_feature: GZ8MTXP01APS7X.38.20.B09.1.454.CMB.2.raw
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (497)..(497): a, c, t, g, unknown or other
  misc_feature (497)..(497): n is a, c, g, or t
  modified_base (525)..(525): a, c, t, g, unknown or other
  misc_feature (525)..(525): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtggcgaggagggccacgatcaactgacaagtccagccggtagtgtttanacaactcaagataagnttnttagcttggacagcagaaaccngacagcctctaagctgctcgtttacnggccctcgtaccgggatcccgggctagacncttcaggtggcggnggtacgtgggctagtacttcactccgtacaccatcagcagcctgcggactagagtatggtacgtgtttatactggtcagtactagttattatcgttactactctacgttagtttcggacgtaagggaccgaagcgttgaagtnttcgcacgtaactgtggctcgcaacttntcg

SEQ ID NO: 338204 - DNA, 587 bp, Homo sapiens
  misc_feature: GZ8MTXP01EY2BK.38.20.B09.1.454.CMB.2.raw
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccagatcaactgcaagtccagccgagttgtttanacaactcaaagaataagagttcttagcttggtaaccagacaacgaaaccacgacacgccctacctaagctagcttacgtttacgngggccctacggtacccgggagtcccggggtcctgaacgtcttcgaggtcgggcggcggggtctagggctagtactttcactcctacacccntcagcacgccgngcggtctagaagtgtgtggtcgtttatcgtcggtcgagtctaagtattactgtttacctccgtactacgttacgtttcggaccggaacgggtaaccgttaagcgttagggagtacgttccgacttacggtaactagggtcggctcgacctaaccttcgtc

SEQ ID NO: 338205 - DNA, 651 bp, Homo sapiens
  misc_feature: GZ8MTXP01A03KD.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgacaagtccagccggtagtgtttanacaactaccaaagaataagtagttcttagcttaggaccagacaagaaaccacgacacgcctacctaagctgtaccttcgtttactcgggcccttacggtaccccggggaacttccccgggggtcctaggaacgtacgttcgagggtcgggccggggtccgggtacgtgggggaacaggtactttaccaccgttcctaccgaccatcacgcacggcctggcgggtacgtagaagtacggtggttgggtacggtttattacgtggtacagtcgtaagttattacgttcgttaccttcctactacgttaggtttcggaccggtaacgggaaccagggtacgttgggaagtacgttaccgcgttaaccggtaacgttcggtcggtcgtcggttacctaacccttaagttccg

SEQ ID NO: 338206 - DNA, 674 bp, Homo sapiens
  misc_feature: GZ8MTXP01DO7ZI.38.20.B09.1.454.CMB.2.raw
  modified_base (251)..(251): a, c, t, g, unknown or other
  misc_feature (251)..(251): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtcctccagacctccctggctgtgtctcgtgggcgaggacgggccacgatcaactgacaagtccgagccggtagttagtttaanaacaactacaaagaataagtattcttagcttaggtaccagacaacgaaaccacgacacgccctacctaagcctgccttcgtttacgtcggtccctaccgtaacccggggtacgttcccgggtacccaggtaaccgtacgttcgaggtcgggcggtccggggtactgggaactagttacgtttaccaccttcctaccgacctataccgacgccgacgtccgtgggccgggtacgtaggtaagtacgtggttacggtacggtttaattacgttggtacgtagtactaagttattattcgttaactcctacgtacgttggtttacggaccggtaacggggaaccaacgggtcgttagggaacgtcgttaccggcttaacccggtaacgtcggtcggtcgtccggacctaaccgttaacgtttcccg

SEQ ID NO: 338207 - DNA, 641 bp, Homo sapiens
  misc_feature: GZ8MTXP01D43TY.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgaggagggccacgatcaactgacaagtccagccggtagtgttttanacaactacaagaataagtagttcttagcttaggacagcaacgaaaccacgacagaccctactaagctcgcttcggtttaaccgtcgggaccccttaccggtaaccccgggggaactttccccgggggtaccctaggaaaccgtaattccggaaggttcggggccgggtccggggtcctaggggaacctaggtaactttcccaactccgtacacctatcagcacgccgtcggcgggactagaagtagtggtcggtcgtttaagttaccgttggtcgagtactaggttattacgttcgttaactccgttactaccgttagtttacgggccgaacggggtaccaaggtccgttagggacgattcgcgaacgtaagtcgtaaggctgactaacttaacgtcg

SEQ ID NO: 338208 - DNA, 759 bp, Homo sapiens
  misc_feature: GZ8MTXP01CZOZE.38.20.B09.1.454.CMB.2.raw
  modified_base (246)..(246): a, c, t, g, unknown or other
  misc_feature (246)..(246): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgaggacgggccacgatcaactgacaagtccagccggtagttgtttanaacaactacaaagtaataagtgttacttagcttaggtaccagaccaagaaaccacgacacgccctactaagcctcgtccttcgttacgcgggtaccccttaccggtaaccccggggaacgttccccgggggtaccctaggtaaaccgtacgtttaccggaggggtcggggcccggggtcggggttaccgtaaggggaacctagggtaccttttacccaacccttcctaccaacccgtataccgacgcctaacggtcccgtcgggacccggggtatacgggtaaagtacgttgggttacgggttacggttttaacgtttaccgttacggggttaacgtaacggttacttaaggtttaactttacgttacggtttacccttacccttacgttaaccggtttaggggttttacgggaaacgggtaaacgggggaaacttaaagggtccgttaagggacgtacgttaccggcgaacggtaacggtggtcgggtctacggacctaaccgttgtttccg

SEQ ID NO: 338209 - DNA, 665 bp, Homo sapiens
  misc_feature: GZ8MTXP01D193A.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaataggcaggcaggggcagcaagatggtgttgcagacccaggtcttcatttctctgttgctctggatctctgttactacaggtgcctacggggacatcgtgatgacccagtctccagacctccctggctgtgtctcgtggggcgaggagggccacgatcaactgacaagtccagccggtattgtttanacaactcaagaataagagttcttagcttggtaccagacaagaaaccacgacacgcctacctaagctgcttcgtttacgtcggtcccctaccgtaaccccgggggaacttccccgggggtacctaggaaccgtacttccgagggtcgggcgggtcggggtcaggggaacctaggtactttccaccttcgtacaacctatacacgcgacgccgtggcggtacgtaggaagtagtcggttacgggttacggtttaagttacgtacgggtacgagtacctagttaatttagttcgtttacctacccttacgtacgttacggtttcggcccgggaacggggtaaccaaggtccgttagggaacgtacgttaccgcgaaccggtaacgttggtaacggtcgttcgaccgtaacccgttaacttccg

SEQ ID NO: 338210 - DNA, 606 bp, Homo sapiens
  misc_feature: GZ8MTXP01DCVGY.38.20.B09.1.454.CMB.2.raw
  modified_base (245)..(245): a, c, t, g, unknown or other
  misc_feature (245)..(245): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggggcgaggacgggccacgatcaactgacaagtccagccggtattgtttanacaactacaaagtaataagtagttacttagcgttacggacagacaacgaaaccacgacacgacctacgtaagctcgtcttacgttacgcggtccctaccggaccgggtacgtcccgggtacctagaacgtctcggaggtcggcgggtcggtacgtagggaactagtactttccactccnctacntcagcacgctggcggacgtagagtagtggtacgtacgtttatcgtggtacagtactagttattactcgttactccgtactagttacggttacggccgaaacgggtaccaaggtcgagggtacgtcgttaccggcgttaacgtaacgtggtcgcgtacgacctaaccgttcgtttccg

SEQ ID NO: 338211 - DNA, 648 bp, Homo sapiens
  misc_feature: GZ8MTXP01EC0KI.38.20.B09.1.454.CMB.2.raw
  modified_base (248)..(248): a, c, t, g, unknown or other
  misc_feature (248)..(248): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtggggcgaggacggccacgatcaactgacaacgtccagccggtagttgtttanaccaactaccaagaataagtagttcttagcttaggtaccagacaacgaaaccacgacacgcctacaagctgtcttcgtttacgcggtcccttacggtacccgggtagtcccgggtacctagacgtactcgaggtcgggcggtcggtcgagggaactagtactttccactcctacactatcacgcacgccgtacggcggtacgttaggaaagtggttcgggtagggttacggtttacgttacgttacggtacgtaagtactaagtttaagtttacgttcgtttacccttccttaccgtaacgttcggtttccgggaccggtaacggggaaccttaaggtcgttaggaagtacgttccgacgttaaccgtaagtggcgttcacgttacctaacgttctttcg

SEQ ID NO: 338212 - DNA, 598 bp, Homo sapiens
  misc_feature: GZ8MTXP01AF7DE.38.20.B09.1.454.CMB.2.raw
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgagacgggccaccatcaactgacaagtccagccagtagttcttttgtcagctaccaagtaatatgagttcgtagtctgtaccagcaagaagcacgacacgtacccctaagtnctactatttagttgtctattcgtacgtcgggtcgtcccgggtctgaccctatacgacgcggacacgcggtatcgtgggaactagtacttcactctacacatcagcacgccngacagtacagggaagtgttggtcgtacttagtttacttacgtagtactacgtaattaaattgttaaggtcggtttacgtcccgttcgggtaccttaccgttaccgggtttcggggaccggggtaacgggtaccgtaaaggggtcggaaagttacgttaaccgaaggttaacccgg

SEQ ID NO: 338213 - DNA, 548 bp, Homo sapiens
  misc_feature: GZ8MTXP01C4QJV.38.20.B09.1.454.CMB.2.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
  modified_base (422)..(422): a, c, t, g, unknown or other
  misc_feature (422)..(422): n is a, c, g, or t
  modified_base (466)..(466): a, c, t, g, unknown or other
  misc_feature (466)..(466): n is a, c, g, or t
  modified_base (543)..(543): a, c, t, g, unknown or other
  misc_feature (543)..(543): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctntgggcgagagggccacgatcaactgcaagtccagccgagtgttanacaactcaagataagagttcttagcttagaccagacagaaaccacgacagcctacctaagcttgcttcgttactgggcccttcgtacccgggaattcccggggtcctagaaccgtacttcgaggtgggccggcgggtctgggcagtactttcacttctcacatcagcacgctggcggctagaagntggttgtcggtttatactggtcagctagtattatgttactcctntacgttaggttcgcccgaaggggtaccaaggtcttgggatacgttcgcgagaacgtggtcggctcgactaaccgttnttccg

SEQ ID NO: 338214 - DNA, 661 bp, Homo sapiens
  misc_feature: GZ8MTXP01BCMLK.38.20.B09.1.454.CMB.2.raw
  modified_base (242)..(242): a, c, t, g, unknown or other
  misc_feature (242)..(242): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagttgtttanacaactaccaagaaataagtagttcttagcttggtaccagacaagaaaccacgacacgcctcctaagctgtctacgtttacgtggccctcgtacccgggaacgttcccggggtaccctgaacgtacttccgaggtcgggccgggccggggtcgtagggtaactagtatttcacctcgtcacatcagcagcctggcgggtcagaagagtggtcggtacggttttaattacgttcggtacgtagtacgtacggttaatttacgtcggtttaccttacccgttactaaccggtttacggtttttcggggacccggtaaacgggggaaccgttaaacggtaccgttagggaaacgtacgttaccggcgttaacggtaaaccgttgggtcggtccgttcggttaccgaaccgttaactttcccg

SEQ ID NO: 338215 - DNA, 734 bp, Homo sapiens
  misc_feature: GZ8MTXP01BUCM8.38.20.B09.1.454.CMB.2.raw
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtcctccagacctccctggctggtgtctcgtggggcgaggacgggccacgatcaactgacaacgtccaggccggtagttgtttaacacaactacgaaagaataagtgttcttagcttaggtaccagacaacgaaaccacgacacgcctactaagctcgtcttacgtttacgcgggtaccctacgtaacccggggtagttccccgggggtcctaaggacgtacgttccggagggtcggggtcccggggtcgggttacgtacggggtaacagttactttcccaccgttctacccaccgtataccgagtcccgaacggtcccgtagggaccggggtacgtaaggaaacgggtcgttacgggttagggttacggttttagttacgttacgggtactacgggtacttaaggtttaactttacgttacgtttaccttacccgttacgtaacggtttacggtttacggggccggtaaacgggtaccgttaaacgtcggttaggtaacggtaacgttccggacgttacgtaacgttcggtaacggtcccgtaggacccttaaccgttgtttccg

SEQ ID NO: 338216 - DNA, 754 bp, Homo sapiens
  misc_feature: GZ8MTXP01AUGA5.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacgatcaactgacaagtccagcggtagttgtttanacaactacaaagaataagtattcttagcttggaccagacaacgaaaccacgacacgaccctaccgtaagtcctgtcctttccgtttacgtcggggtccccttaccggtaaccccgggggaacgttccccgggggtaccctaggtaaaccgtacgtttaccggagggttcggggccggggtaccggggttaccgtagggggaacctagggttacttttacccgaaccttccgttaccgaaccctataccgacgaccgacggtcccgtcggaccgggtacgtaggaaacgtgttacgggttacgggttaccgggtttaattacgttacggggtacgtaggtacgttaagtttaacgtttaagttcgtttaccttacccgttaccgtaacgttacggttttaccgggacccggtaacggggtaacccgaaacggtccggttagggaacgtacgttaccggttaccgaacggtaacggtcggtcggacctcggaccctaaccgttaacttcccg

SEQ ID NO: 338217 - DNA, 705 bp, Homo sapiens
  misc_feature: GZ8MTXP01A4MGI.38.20.B09.1.454.CMB.2.raw
  modified_base (252)..(252): a, c, t, g, unknown or other
  misc_feature (252)..(252): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtggggcgaggacgggccacgatcaactgacaacgtccagccggtagttagtttaanactaactacaaagtaataagtagttacttagcgttaggaccagacaacgaaacccacgacacgtaccctacctaagtcctacgtccgttacggtttaccgtcggggtccccttaccggttaaccccgggggaacgttccccgggggtaccctaggaaccgtacgttcggaggtcggggcgggtccggtacgtggggaactagtactttcacctctacacctatcacgcacggccgtcgggcgggtacgtaggtaacggtagttcgggtcggttacggtttaacgttacgtaggggtccgtaggtccttaagttaactttacgttcgtttacctcccttacgtaccgtttagggtttccgggaccggtaacggggaaccttagggtcgagggtaacgtacgttaccgcgttaacggtaacgtggaacgtccgtcggacctaaccttgttaaccg

SEQ ID NO: 338218 - DNA, 643 bp, Homo sapiens
  misc_feature: GZ8MTXP01BFTNN.38.20.B09.1.454.CMB.2.raw
  modified_base (246)..(246): a, c, t, g, unknown or other
  misc_feature (246)..(246): n is a, c, g, or t
  modified_base (506)..(506): a, c, t, g, unknown or other
  misc_feature (506)..(506): n is a, c, g, or t
  modified_base (549)..(549): a, c, t, g, unknown or other
  misc_feature (549)..(549): n is a, c, g, or t
  modified_base (619)..(619): a, c, t, g, unknown or other
  misc_feature (619)..(619): n is a, c, g, or t
  modified_base (625)..(625): a, c, t, g, unknown or other
  misc_feature (625)..(625): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgaggacgggccaacgatcaactgcaagtccagccggtagtgtttanacaactcaaagtaataagattcttagcttggtaccagacaagaaaccacgacacgcctaccaagctgccttacgtttacgcggtcccttaccgtaacccgggaagttccccggggtacctaggaaccgtacttcgaggtcgggaccggtcggggttacctaggggaacctagtactttccaccttccgaccaaccctatccaacggtcacggcctgggacgggtactaggaagtagtggttacggtcggtttaattccgnggttacaggtacctaaggttattaacgttcgttacttcccctntaacgttaggtttcgggacccgtaacggggacttaagtcgttagggactacgttcgccgacgtaattcgnggtccngaccgtaacttcgttccg

SEQ ID NO: 338219 - DNA, 588 bp, Homo sapiens
  misc_feature: GZ8MTXP01CBUKP.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtggggcgagagggccacgatcaactgacaagtccagccggagtgtttanacaactccaaagaataagtagttcttagcttggaccagacaacgaaaccacgacagccctacctaagctgccttcgtttactcgggccctcgtacccgggatcccggggtcctgaacgtcttcgaggtggccggcgggtctgggcagtacttcactctcacatcagcacgctggcgggctggaagtgtgtggtcggtttattacgtggtcagctagttattatcgttactcctctacgtacgtttcggaccggtaacggggaacccttaaggcgttaggtacgtacgttaccggcgttaaccggtaacgtggtcggtccgtcggaccctaaccgttaacgttccg

SEQ ID NO: 338220 - DNA, 682 bp, Homo sapiens
  misc_feature: GZ8MTXP01AKSXS.38.20.B09.1.454.CMB.2.raw
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaacgtccagccggtagtttagtttaactaacaacctaccgaaaagtaaataagtagtttcttaagcgttacggtaccagacaaacgaaacccacgaacacgtccctacgtaacgctcgtccttacggtttaccgtcgggtcccctaccggtaaccccgggaacgttccccgggggtacctagaacgtccttcgaggtcggggcgggtcggtactggggaacagtactttccgactcctacacctactcgacgcacgccgtcggcgggacgtagtaacgtagtggttcgggttacggtttagttacgttacggtcgtacgtactaaggtttactttagttcgtttaaccttccgttacgtacgttacggttttacggccgggtaacggggccaagggtcgttacgggtacgtacgttcgacgttaccggtaacgtggtcgcgtcgactaacgttaactttccg

SEQ ID NO: 338221 - DNA, 708 bp, Homo sapiens
  misc_feature: GZ8MTXP01CXJAU.38.20.B09.1.454.CMB.2.raw
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtcctccagacctccctggctgtgtctcgtggggcgaggacgggcacgatacaactgaccaagtccagccggtaagttgtttaanaccaactacaaagtaataagtagttcttagcttacggtaccagacaacgaaaccncgacncgcctacaagctgtccttacgttacgcgggtacccttaccggtaacccggggtaacgttccccgggggtaccctagaaaccggttgttaccgaggtcgggccggtcgggttaaccgagggaactaacgttactttaccacctcctaccaactactacgacgacgacgcgtcgtcgtagtacgtagaacgtagttcggtacgggttacggtttacgttaacggtcggttacgtacgttagtaacggtttaatttacgttacggtttaaccttccgtaaccgttacggttacgggttttaccggaacccgggtaacgggaaccgtaacggttacggtacggtaacgttacgttcggaccgtaacgtaaccgtggtcgccgttacgcccttaacgttcg

SEQ ID NO: 338222 - DNA, 575 bp, Homo sapiens
  misc_feature: GZ8MTXP01DLK2M.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccaacgatcaactgacaagtccagccggattgtttanacaactcgagaataagtgttcttagcttggaccagacaagaaaccagacagcctactaagctgtcttcgtttactgggcccttcgacccgggattcccggggtcctagaaccgtatccgaggtcggccgggcggtactgggcagtactttccactctcacatcagcacgctgcggctgaagtagtgttacggtgtttacttacgtggtacgagtactagttacttagtcgtttactcctctagttaggtttcggacgtaacgggaaccaaggtcgttggagtacttccggcgttaacgtaacgttggtgtctcgacctaacgttaacttccg

SEQ ID NO: 338223 - DNA, 655 bp, Homo sapiens
  misc_feature: GZ8MTXP01BD620.38.20.B09.1.454.CMB.2.raw
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacgggacatcgtgatgacccagtctccagactcccgtggctgtgtctcgtgggcgagagggccacgatcaactgcaagtccagccggagttgtttanacaactcaagaatagagttcttagcttggacagcaagaaaccncgacacgccctactaagctgcttcgtttacgtcggccctacgtacccgggattccccggggtacctaggaaccgtacttccgacggtcgggaccgggtccgggtacgtacggggaactaggtactttccgaccttcctacacctactctacgcacgccgtggcgggacgtaggaaagtacgtggttacggtacggtttaagttaccgttggtacgtacggtactaggttaacttacgttcgtttaacctcccgttactaacgttacggttttcggacccggtaacgggaaccgttaaaggtcgttacggagtacgttacggacgttaacgtaacgttacggtcggtcgtcgacctaaccttaacgttccg

SEQ ID NO: 338224 - DNA, 628 bp, Homo sapiens
  misc_feature: GZ8MTXP01BAIOJ.38.20.B09.1.454.CMB.2.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgagagggccagatcaactgcaagtccagccggatgtttanacaactcaagaataagagttcttagcttggtaccagacaagaaaccacgacagcctactaagctgcttcgtttacnggccctcgtaccgggatcccgggtcctgacgattcgagtggcggcggtctgggcagtattcactctacactatcagcacgccgtggcgggactaggaagtagtaggttcgggttcgttttaagttaccgtggggttacgtaagtctaaggtttatttacgttacgtttaccttcccttaacgtaccgtttacgggttttcgggaacccggtaacgggggtaacccgttaaggtaccgttagggaaacggtaccgttacggaccgttaaccgtaagtcggttaacggcgttaccggacctaaccttaagtttcccg

SEQ ID NO: 338225 - DNA, 682 bp, Homo sapiens
  misc_feature: GZ8MTXP01BEK42.38.20.B09.1.454.CMB.2.raw
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacgggacatcgtgatcgacccagtcctccagacctcccgtggctgtcgtctcgtgggcgaggcgggccagatacaactgacaacgtccgagccggtagttgtttaanacaactacaaagtaactaagtattcttagcttacggtaccagacaacgaaaccncgaacacgcctacctaagctgtacctttaccggtttacncggggtacccttaccggtaacccgggtacgttcccgggggtaccctaggaaaccgtacgtttccggaggttcgggccgggtcgggttacgtcgggaactaggtactttcccacgtctaccgactactcacgcacgcccgtggcggactagaacgtgcggttagggtaccgttttagtactgggtcgagtacgttagttattacgttcttaaccttcccgttactacgttacggtttcggaccggtaacgggtaaccaacggtcgttaaggtaacgacgttacccgggcttaacccggaagtttcgggccgtcgtacggacctaaccttcgtttcccg

SEQ ID NO: 338226 - DNA, 651 bp, Homo sapiens
  misc_feature: GZ8MTXP01EMORX.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagactcccgtggctgtgtctcgtggcgagagggccagatcaactgacaagtccagccggtagttgtttanacaactacaaagtaataagtagttcttagcttaggtaccagacaacgaaaccacgacacgccctacaagctcgtcttacgttacgtcggcccttacggtaacccgggacttccccggggtccagtaacgtacttcggaggtcgggcggtccgggtacgacggggaactagtactttaccaccttacctaccaactactcgacgccgacgtccgtcggcgggtacgtaggaagtagtggttggtacgtttattacgtggtactagtacttaagttattagttcgtttaccttaccttacgtacgttacggtttacggaccggtaacgggtaaccgttaggtacgttaggacgtacgttcgaccgacggtaacgtcggtaacgtcgtacgacctaaccgttcgtttccg

SEQ ID NO: 338227 - DNA, 620 bp, Homo sapiens
  misc_feature: GZ8MTXP01B4G3G.38.20.B09.1.454.CMB.2.raw
  modified_base (238)..(238): a, c, t, g, unknown or other
  misc_feature (238)..(238): n is a, c, g, or t
  modified_base (407)..(407): a, c, t, g, unknown or other
  misc_feature (407)..(407): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagcgtagtgtttanacaactcaagaataagattcttagcttggaccagcagaaaccacgacacgcctacctaagctcggcttacgtttacgtcggggtcccctttcgtaaccccggggaattccccgggggtaccctaggaaccgtctttccgaggtcgggccgggcgggtacctggggaacnggtaacttttccgactctcgaccatcagcacgcctggcgggctagaagagtggtggtcggtttagttactggtcgtagtcctaggttacttacgttcgtttaaccttccctcgtaccgttacggttttacggcccgtaaggtcggaaccgtaacgcgttagggacgttacgttcgaccgtaacgtaacgtgtcggcttcgtaacttcccgtaa

SEQ ID NO: 338228 - DNA, 587 bp, Homo sapiens
  misc_feature: GZ8MTXP01B7IAR.38.20.B09.1.454.CMB.2.raw
  modified_base (246)..(246): a, c, t, g, unknown or other
  misc_feature (246)..(246): n is a, c, g, or t
  modified_base (584)..(584): a, c, t, g, unknown or other
  misc_feature (584)..(584): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagactccctggctgtgtctcgtgggcgaggacgggccacgatcaactgacaagtccagccggtagttgtttanacaactacaaagaataagtagttcttagcttaggtaccagacaacgaaaccacgacacgcctactaagctgccttacgtttacgcggccctcgtaacccgggatcccggggtcctaggaacgtacttcgaggtcggccggcggtacgtgggctagtactttcactctcacatcagcagcgtgcggactagaagtagtggtggtcggtttattacgtggtctagtctagttagttctacgttacctacctctacgttacggtttcggaccgtaacggggaccttaaggtcgttagggagacgttcgacaacgtaacgtgtaacggctcgactaacgttntcg

SEQ ID NO: 338229 - DNA, 706 bp, Homo sapiens
  misc_feature: GZ8MTXP01EI10N.38.20.B09.1.454.CMB.2.raw
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacgatcaactgacaagtccaggccggtagttagttttaacaacaactaccaaagtaattaagtagtttctttagcttacggtaaccagacaagaaaccacgaacacgccctacgtaagctcgtccttacgtttacgcgggtacccctaccggtacccggggtaacgttcccggggtccctaggaacgtcttcgaggtcgggcgggtcggtcgtagggctagtactttccaactctacgacatccagccacgccgtggcggtactaggaacgtggtggttacgggttacgttttaacttacgttacgggtactagttactaagtttatttaacgttcgtttaaccttccttacgttaacggtttacgggttttaccggaacccgggtaaacgggggtaaaccttaacgggtacggtttacggaaacggtacgttacccggaacgttaacccggtaagttcgggtaaccggtctacgaccctaaccgttaacttttccg

SEQ ID NO: 338230 - DNA, 635 bp, Homo sapiens
  misc_feature: GZ8MTXP01BQOVZ.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtggcgagacgggccacgatcaactgacaagtccagccggtatgtttanacaactcaagaatagattcttagcttaggtacagacaacgaaaccacgacacgccctacctaagctcgtcttacgtttacgcgggtccctaccggtaacccggggtacgtcccgggggtccctaggaaccgtcttcgaggtcggggccgggtcgggtacgtacgggaactaggtactttccgaccttcctacacctactcacgcgacgccgtacgggtcgggacgtagaaggtgtggttcggttacggtttattacgtggtacgagtactagttattacgttcgttacctacctcgtacgttacggtttccggcggaacgggtaccgaggtcgttaggacgtacgttcgcgacgtaacgtggtcgtcgtcgaccgtaaccttaacgttccg

SEQ ID NO: 338231 - DNA, 745 bp, Homo sapiens
  misc_feature: GZ8MTXP01CTTX7.38.20.B09.1.454.CMB.2.raw
  modified_base (251)..(251): a, c, t, g, unknown or other
  misc_feature (251)..(251): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtggggcgaggacgggccacgatacaactgaccaagtccagccggtagttgtttanacaactacaaagaatagtattcttagcttaggtaccagacaacgaaaccacgacacgtccctactagtctcgtcgttacgttaccgcggtaccctacggtaacccggtacgtcccgggtacctcgtaacgtacttcggaggtcgggtcgggtccgggtacggtacgggaacgtagtacttcctactcctactaccactacgtacgacacggtccgtgggaccgggtactaacggtaaaggtacgttacgggttacgggtttaaccggttttaatttaccggttacggggttacggtaacgttacgttaagtttaaacgtttactttacccggtttaccttaccccgttcgtaaaccgttttacgggttttccgggaaccccgggtaacgggggtaaacccttaggggtcccgttaagggtaaacgtacgttacccgggacgaaccgggtaaccgtgggtccggacctacgttaccctaacccgttaatttcccg

SEQ ID NO: 338232 - DNA, 660 bp, Homo sapiens
  misc_feature: GZ8MTXP01DVHGV.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacgggacatcgtgatcgacccagtctccagacctcccgtggctgtgtctgtggggcgagcgggccacgatcaactgcaagtccagcggtattgtttanacaactacaaagaataagtgttacttagcttaggacagacaagaaaccacgacacgaccctactaagctcgtcgttacgtttacgtcggcccttaccggtaacccgggtacgttccccggggtacctaggtaaccgtacgtttccgagggtcggggccggtcggggtacgtagggaactagtactttccgactccacgacatcgagcgacgcgtggcggtacgtagaagtagtggttcggtacggtttatacgttgggtactagtacttaagttattagttacgttaactccgtactacggttacgtttcggaaccgggtaacgggaaccgttaaggtcggttaagggacgtacgttacccggacgttaaccggtaactgggtaacggtctaccggttacctaacgttaactttccg

SEQ ID NO: 338233 - DNA, 659 bp, Homo sapiens
  misc_feature: GZ8MTXP01BYXL3.38.20.B09.1.454.CMB.2.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgaggacgggccacgatacaactgacaagtccgagccggtagttgttttaanacaactacaagaataagtattcttagcttcggtaaccagacaagaaaccacacacnccctactaagctcgcttcgtttacgcgggccctcggtaacccgggtagtcccgggtccctaggaccgtagttcgaggtgggccgggtcggttacgtagggaacctagtactttaccacctcctaccgacctataccacgcacgccgtgggcgggtctaggaagtggttagggttcgggttacggttttacttacgtacggtacgtaacggtataaggtttattacttcgtttacccttccgttactacggtttacggtttcgggacccgtaacgggggaaccttaaggcgttaggtaacgcgttccggacttacggtaacgtggtcggctacggacctaaccgttctttccg

SEQ ID NO: 338234 - DNA, 614 bp, Homo sapiens
  misc_feature: GZ8MTXP01CJZXG.38.20.B09.1.454.CMB.2.raw
  modified_base (248)..(248): a, c, t, g, unknown or other
  misc_feature (248)..(248): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtgggcgaggagggccacgatacaactgacaagtccagccggtagttgtttanaccaactacaaagtaataagtagttcttagacttggaccagacaacgaaacccacgaacacgccctacctaagctcgtcttacgttacgcgggcccttacggtacccgggtattcccggggtccagaaccgtcttcggaggtcgggcggtcgggtactagggaactagtacttcactcacacatcagcacgccgtgcggtactagaagtgtggttagtacggtttatacgtggtcagtctaagttattacgttcgttacctcctacgtacgttacggttaccggccggtaaacggggtaccaaggtcgttaggaacgtacgttacgcgttaaccgtaagtggtcggctcgacctcgttaacgttcg

SEQ ID NO: 338235 - DNA, 588 bp, Homo sapiens
  misc_feature: GZ8MTXP01EEZCQ.38.20.B09.1.454.CMB.2.raw
  modified_base (243)..(243): a, c, t, g, unknown or other
  misc_feature (243)..(243): n is a, c, g, or t
  modified_base (487)..(487): a, c, t, g, unknown or other
  misc_feature (487)..(487): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagactccctggctgtgtctcgtgggcgagacgggccacgatcaactgacaagtccagccgagttgtttanacaactaccaaagtaataagtagttcttagcttaggtaccagacaagaaaccacgacacgcctactaagctcgcttacgttacgtcggtccctcgtacccgggtacgtcccgggtccaggaaccgtacttacgaggtcgggccgggtccgggtcgtagggaactagtactttaccgactcctacacctatccagcacgcgtggcggactagacgtagtggttacggtcgtttattactggtacngtactagttattattcgttacctctctacgttgtttcggcgtaacgggaacaggcgttggatacgcgcacggtaacgtggtcggctcgactccttgttccg

SEQ ID NO: 338236 - DNA, 763 bp, Homo sapiens
  misc_feature: GZ8MTXP01DT285.38.20.B09.1.454.CMB.2.raw
  modified_base (248)..(248): a, c, t, g, unknown or other
  misc_feature (248)..(248): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgaccagtctccagactcccgtggctgtgtctcgtggcgaggacgggcacgatcaatgacaagtccgaggtccggtagttagtttaanaacactaccaaagtaataagtagtttcttagcgttaggtaccagacaacgaaacccacgacacgtaccctaccgtaagtctacggtcctttaccggtttaccgtcgggtaccccctttaccggtaaccccgggggtaacgttcccccgggggttaccctacggtaaccgtacgttacgacggggttcgggccgggtccggggtaccggtagggtaaccgtagtaccgttttccaacctccgtacaacctacgtaccgagccgacgtcccgtacgggacgggtaccgtagaaaggttgttacggggttacgggttaaccggttttaagtttacccggtttgttacccggtaagtaccttaaggtttatttaacgtttcgtttaccttaccgttacttaacggttacggtttccgggaccgggtaaacggggtaccgacggtcgttagggaaaccgtgacccggacttaaccggtaacgttcggtcgtaccgtacgttaccgtaaccttcgtttccg

SEQ ID NO: 338237 - DNA, 620 bp, Homo sapiens
  misc_feature: GZ8MTXP01ENONY.38.20.B09.1.454.CMB.2.raw
  modified_base (310)..(310): a, c, t, g, unknown or other
  misc_feature (310)..(310): n is a, c, g, or t
  modified_base (579)..(579): a, c, t, g, unknown or other
  misc_feature (579)..(579): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgaccagtctccagactcccgtggctgtgtctcgtggcgaggacgggccagactacaactgacaacgtccaggtccggtagttagtttaacaacaactaccaaagtaataagtattacttagcgtagaccagacaacgaaaccacgacncgcctacagctcgcttcgttacgcggtcccttaccggtaccgggagtcccgggtactagaacgtctcgaggtggcggtcggtcgaggctagtacttcacttcaccactatcacgtcgacgtccgtcggcggtacgtaggaagtcgtgggttcggttacggtttacttacgtgggtacgtagtacgtagtttatcgttacgttacctccgtaccgtgttaaggttccggacggaacgggtaccagggtacgttagggaacgtacgcccgngttaaaccggtgtcggtcggctacgacctaacttcgttccg

SEQ ID NO: 338238 - DNA, 690 bp, Homo sapiens
  misc_feature: GZ8MTXP01DKUUA.38.20.B09.1.454.CMB.2.raw
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccaacgatcaactgacaacgtccaggccggtagttagtttanaacaactacaaagtaataagtnttcttagcttggtaccagacaacgaaaccacgacacgccctactaagctagtccttcggtttaactcgggcccttaccgtaccccgggggaacttccccgggggtacctaggaacctacttccggagggtcgggccggggtcgggtacctaggggaactaggtactttcccaactccctacgaccatcagtcacgcccgtggacggtactaggaagtggttgggttaggttaccgttttaaattccgttggtaccgtaagttaccgtaagttatttacgttaccggtttacctacccgttcgtaaccgtttacgggtttccgggcccggtaaacgggggtaacccttaaggtccgttaggggaaactcgttaccggaccttaacggtaagtcggtcggctaggaccctcttaacgtttcc

SEQ ID NO: 338239 - DNA, 673 bp, Homo sapiens
  misc_feature: GZ8MTXP01E0EY6.38.20.B09.1.454.CMB.2.raw
  modified_base (185)..(185): a, c, t, g, unknown or other
  misc_feature (185)..(185): n is a, c, g, or t
  modified_base (311)..(311): a, c, t, g, unknown or other
  misc_feature (311)..(311): n is a, c, g, or t
  modified_base (625)..(625): a, c, t, g, unknown or other
  misc_feature (625)..(625): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacgaggtcgccgtacgggacatcgtgatcgacccagtctccagacctcccnggctgtgtctgtggcgaggacgggccacgatccaacgtgaccgaacgtccgagtccggtagttgttttaacacaaactaccaaagaattaagtagttcttagcttaggaccagacaacgaaacccncgacacgccctacctaagctacgccttacgtttacgccggcccttaccgtaccccggggtacgttcccgggggtacccaggaaccgtacttcggaggtcggggccgggtcgggtacgtcgggaactagtacttccacttccacaccaaatcacgcgtacgccggcggcggtacgaattgtaacgggtacggttccgtttaaggtcccggtttattaccggaggtacctaggttactaggttacgtttacctccgttacctaccgttcgtaccgacgggtttacgggaacccaggggttccaaggacgttcgggnacgacgttaccgtaacgtacggtaacgtcgtcgacctaacgccgtccg

SEQ ID NO: 338240 - DNA, 683 bp, Homo sapiens
  misc_feature: GZ8MTXP01ASVGF.38.20.B09.1.454.CMB.2.raw
  modified_base (247)..(247): a, c, t, g, unknown or other
  misc_feature (247)..(247): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctcagactcccgtggctgtgtctcgtggcgaggagggccacgatcaactgacaacgtccagccggtagttgttttaanacaactaccaaagtaataagtagttcttagcttaggtaccagacaaggaaaccacgtacacgcctactaagctcgcttcggtttacgcggtccctacgtacccgggacttcccgggtcctaggacgtaacttcgacgtcgggcggtcgtcgtagggctagtactttcgactctacgaacctagtcacgacacgtccgtcggaccgggacgtaggtaagtacggttagggttacgggttaccggttttaagttaaccgtacggggttactaggtaaccgtaagtttaagttaactttacggtttaacccttccgtacgttaaccgttacggttttcgggacccggtaacgggggtaacccttaagggtaccgttaggtaacgtacgttacggaccgttaacgtaaccgtggtcgacgtcggactaacgttcgttccg

SEQ ID NO: 338241 - DNA, 638 bp, Homo sapiens
  misc_feature: GZ8MTXP01BCYTQ.38.20.B09.1.454.CMB.2.raw
  modified_base (244)..(244): a, c, t, g, unknown or other
  misc_feature (244)..(244): n is a, c, g, or t
  modified_base (369)..(369): a, c, t, g, unknown or other
  misc_feature (369)..(369): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgaggagggccacgatcaactgacaagtccagccggtagttgtttaanacactacaagaataagagttcttagcttggtaccagacaagaaaccacgacacgcctactaagctgtcttcgtttacgcggtacccctcgtaaccccgggtagtcccgggtacctaggaaccgtnttcgaggtcggccgggtcggtactaggggaactagtaacgtttcaccttctaccacctaaactcgacgacgtacgcgtacggccgggtagtaggaagtagtcggttggttacggtttattacgtcggtacgtagacgtaagttatttacgtcgtttaccttccgttaccgtacgttacgttttcgggaccggaacgggtaacttacggtcgttacggagtaacgttcgcgaacgtaacgtggtcgacgtcgacctaaccgttaagttcg

SEQ ID NO: 338242 - DNA, 596 bp, Homo sapiens
  misc_feature: GZ8MTXP01ETU55.38.20.B09.1.454.CMB.2.raw
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctcagactccctggctgtgtctcgtggcgagaggccagactcaactgacaagtccgagccgtagttgtttanactaactacaagtaaatagtgttacttagcttaggaccagacaagaaaccngacagcctaccgaanctgtcttcgttacgtcggcccttcgtaaccgggatcccgggtcctagacgtntccgaggtcgggacgcggttacgagaacgtgtaacgtttcactcgtacactanacgacgcncgccgtggacgtagtagtaagtgttcggttaggttacgtttagtacgttgtacgtagtacttaagttatttcgttcgttactacctacgtacgttacggttaccggacgtaacgggtacaaggtcgaggtactacgcgacgacgtaacgtgtaacgtctacgacctcgttaacgttcg

SEQ ID NO: 338243 - DNA, 739 bp, Homo sapiens
  misc_feature: GZ8MTXP01DS36B.38.20.B09.1.454.CMB.2.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (443)..(443): a, c, t, g, unknown or other
  misc_feature (443)..(443): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcagagggccacgatcaactgacaagtccagcgagttntttanacactcaagatagatcttagctgtacagcaagaaaccacgaacngacctcccgtaaagtccttcgcccgttcgtttaaccgtcgggacccctacgacccccggggtaagtacccccgggggttccctaggaaacgtacgttccagggtacggggtcgggccgggttaccgtagggggtccaaagtacttttacgacccctttcncgtacccaataccgacgacgaacggcccgttcggacggggtcgacggtaacggtaaggtcgtaggggttccgggttttaagtttaccggttacgggttaccgtacgtaaccgttaggttaactttaacgtttggttttaacccgttaccgttaccctacccgttaggttttacggtcccggtaaccgggggaacggttacccggaaggttacggggaggttaccgaacggttccgttaaaccggtccgttaaagggttccggtcgttccggttacctaacccgttaaccgtttccg

SEQ ID NO: 338244 - DNA, 504 bp, Homo sapiens
  misc_feature: GZ8MTXP02JEM13.38.20.B09.1.454.CMB.2.raw
  modified_base (238)..(238): a, c, t, g, unknown or other
  misc_feature (238)..(238): n is a, c, g, or t
  modified_base (369)..(369): a, c, t, g, unknown or other
  misc_feature (369)..(369): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttactgggccctctacccgggaatccggggtccctgaacgattcagtgcggcggtctgggcngatttcactctcaccatcagcagcctgcggctgaagatgtgcggtttatactgtcagcagtatatgttactctctactagtttgcgtacggggtaccaagcgtggagactcgcacgaacgtgtcggctgcacatc

SEQ ID NO: 338245 - DNA, 588 bp, Homo sapiens
  misc_feature: GZ8MTXP02G1H6M.38.20.B09.1.454.CMB.2.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggaggccgacgaagtccgaactgacaagtccagccggatgtttanacactcaagatagnttcttagcttgacagcaagaaaccacgacagcctactaagctgctcgtttacgcggccctacgtacccgggatcccggggtcctagaacgacttcgaggtcggcgggtcggtcgtagggactagtactttccgactctaccaacctatacacgacgacgcgtcgcggcgtagaagagtagtggtacggtttagttacgtacgtcgtagtacgtagttagttagttacgttacttcctactacgtacgtttacggtacggtacgggacgaacgtacgtacggacgacgtacgacgacgtaacgtacgtacggtcgtacgacgacctacgtcg

SEQ ID NO: 338246 - DNA, 344 bp, Homo sapiens
  misc_feature: GZ8MTXP02IOYC0.38.20.B09.1.454.CMB.2.raw
  modified_base (258)..(258): a, c, t, g, unknown or other
  misc_feature (258)..(258): n is a, c, g, or t
  modified_base (341)..(344): a, c, t, g, unknown or other
  misc_feature (341)..(344): n is a, c, g, or t
tcagtcgatcacgtcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaaggcccatcggtctcccctgcaccctctcaagncacctctggggcacagcggcctgggctgcctggtcaaggactactccacgtgatcgactgagcgggctggcaaggcgcatagnnnn

SEQ ID NO: 338247 - DNA, 499 bp, Homo sapiens
  misc_feature: GZ8MTXP02F6ZKN.38.20.B09.1.454.CMB.2.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (444)..(444): a, c, t, g, unknown or other
  misc_feature (444)..(444): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttacngggccctctacccgggaatccggggtcctgaacgattcagtggcggcggtctggggcagatttcactctcaccatcagcagctgcgggctgaagatgtgcgtttatactgtcagcagtatatgttactcctnactagtttgctaggggaccaagctggagatcgcacgaacgtgtggctgcaccatc

SEQ ID NO: 338248 - DNA, 536 bp, Homo sapiens
  misc_feature: GZ8MTXP02I3Q99.38.20.B09.1.454.CMB.2.raw
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
tcagtcgatcacgtcacgaccggtgctcgatttagtgtagtgtgaaggggagctacaacaggcaggcagggcagcaagatggtgttgcagacccaggtcttcatttctctgttgctctggatctctgttactacaggtgcctacgggacatcgtgatgacccagtctccagactcctggctgtgtctcgtgggcgagagggccacgatcaactgcaagtccagccgatgttanacaactcaagaataagngttcttagcttggaccagacaagaaaccacgacagcctctaagctgctcgttacnggccctcgtaccggatccggggtcctagaacnttcgagtcggcggcggtctgggacagtacttcactctacacntcagcacgctgcggctagaagngtggtgtcgtttatacgtgtcagctagttattatcgttactctacacttaggtttcggaccgtacggggacctaaggtcgtaggagtacgtaccgacgaacgtaacgtggtacgtcgtcgacctaccgtacttcg

SEQ ID NO: 338249 - DNA, 503 bp, Homo sapiens
  misc_feature: GZ8MTXP02JRXO0.38.20.B09.1.454.CMB.2.raw
  modified_base (239)..(239): a, c, t, g, unknown or other
  misc_feature (239)..(239): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttactgggccctctacccgggatccggggtccctggaacgattcagtggcggcgggtctgggcagatttcgactctcaccatcagcagcctgcgggctgaagatgtagcgtttatactgtcagcagtattatgttactctcactagtttgctagggaccaagctggagactcgcacgaacgtgtcgctgcacatc

SEQ ID NO: 338250 - DNA, 576 bp, Homo sapiens
  misc_feature: GZ8MTXP02IZ22Y.38.20.B09.1.454.CMB.2.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactcaaagaataagagttcttagcttggtaccagcaagaaaccacgacagccctacctaaagctgcctcgtttacngggcccttcgacccgggaatcccggggtcctagaacgtatcaggtggcggtcggtctggggacagtatttccacttctacaccatcagcagcctggcgggctagaagagtggtgggtcggtttaattacgtgtacgtagctagttattagttgttaacctcctactacgtaggtttcggacccgtaaggggacccaaaggtcgtagggacgtacgtccgacaacggtaacgtggtcggtctcggaccaccgtattccg

SEQ ID NO: 338251 - DNA, 516 bp, Homo sapiens
  misc_feature: GZ8MTXP02GRCF0.38.20.B09.1.454.CMB.2.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (513)..(513): a, c, t, g, unknown or other
  misc_feature (513)..(513): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacactcaagataagngtcttagcttggaccagcaagaaaccacgacagcctcctaagctgctcgtttacngggccctcgtacccgggaatccggggtccngaacgattcagtggcggtcgggtctggggcagatttccactcctcaccatcagcagcctgcgggctgaagagtgtggacggtttattactgtcagctagtattatgttactctcactagtttgcgtacgggaccaagcgtggagactcgcacgaacgtggtcggctgcaacctntcg

SEQ ID NO: 338252 - DNA, 529 bp, Homo sapiens
  misc_feature: GZ8MTXP02GCBVP.38.20.B09.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactccaagaataagagttcttagcttggtaccagcaagaaaccacgacagccctctaagctgctcgtttacngggcctcgtacccgggatccggggtcctgaacgattcgagtggcggcggtctggggcagtatttccactctcaccatcagcagcctgcgggctgaagagtggtggtcggtttattacgtgtcagctagttattagtgttactcctctacgtagtttcggcgtacggggaccagcgtggacgactcgacacgaacgtgtcggctcgacacactcg

SEQ ID NO: 338253 - DNA, 505 bp, Homo sapiens
  misc_feature: GZ8MTXP02HJ1WO.38.20.B09.1.454.CMB.2.raw
  modified_base (237)..(237): a, c, t, g, unknown or other
  misc_feature (237)..(237): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactccaagataagagttcttagcttggtaccagcaagaaaccacgacagcctctaagctgctcgtttactgggccctctacccgggaatccggggtccctgaacgattcagtggcggcgggtctggggacagtatttcactctcaccatcagcagctgcggctgaagagtgtgcggtttatactgtcagcagtattatgttactctcactagtttgcgaggggaccaagcgtggacgactcgcagaacgtgtcggctgcacactc

SEQ ID NO: 338254 - DNA, 508 bp, Homo sapiens
  misc_feature: GZ8MTXP02FQ22L.38.20.B09.1.454.CMB.2.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttacngggcctctacccgggaatccggggtcctgaacgattcagtggcggcggtctggggcagatttcactctcaccatcagcagcctgcgggctgaagagtgtggtcggtttattactgtcagcagtattatgttactctcactagtttggcgaggggaccaagctggagactcgcacgaacgtgtggctgcaccatc

SEQ ID NO: 338255 - DNA, 501 bp, Homo sapiens
  misc_feature: GZ8MTXP02GHSLL.38.20.B09.1.454.CMB.2.raw
  modified_base (238)..(238): a, c, t, g, unknown or other
  misc_feature (238)..(238): n is a, c, g, or t
  modified_base (345)..(345): a, c, t, g, unknown or other
  misc_feature (345)..(345): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaagctgctcgtttactgggcctctacccgggaatccggggtcctgaacgnttcagtggcggcggtctgggcagatttcactctcaccatcagcagcctgcgggctgaagatgtggcggtttatactgtcagcagtattatgttactctctacagtttggcctaggggaccaagctaggacgatcgcacgaacgtgtgctgcacatc

SEQ ID NO: 338256 - DNA, 574 bp, Homo sapiens
  misc_feature: GZ8MTXP02G7T1V.38.20.B09.1.454.CMB.2.raw
  modified_base (238)..(238): a, c, t, g, unknown or other
  misc_feature (238)..(238): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactccaaagaataagagttcttagcttggtaccagcaagaaaccacgacagcctcctaagctgctcgtttactcgggccctcgtacccggggaacttccccggggtccctggaaccgacttcgaggtcggggccgggtcggggttctggggactaggtactttccgactctcaccatcagcacgccgtggcgggctaggaagtagtggtggtcggtttatacgtgtacagctagttattagtcgttactcctctacgtagtttcggaccgtaacgggaccaagcgtaggacgtacgtcgacgacgtaacgtggtacggctcgcctacctatcg

SEQ ID NO: 338257 - DNA, 513 bp, Homo sapiens
  misc_feature: GZ8MTXP02JSE0T.38.20.B09.1.454.CMB.2.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcaagaaaccacgacagcctcctaagctgctcgtttacngggccctcgtacccgggaatcccggggtcctgaacgacttcagtggcggcggtctgggcagtatttcactctcaccatcagcagcctgcgggctgaagatgtggtcggtttattactgtcagcagttattatgttactctcactagtttggccgtacgggaccaggcgtggagactcgcacgaacgtgtcgctgcaccatc

SEQ ID NO: 338258 - DNA, 510 bp, Homo sapiens
  misc_feature: GZ8MTXP02JYC02.38.20.B09.1.454.CMB.2.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccagacagcctctaagctgctcgtttacnggcctcgtacccggatccggggtcctgaacgattcagtggcggcgggtctgggcagactttcactctcaccatcagcagcctgcggctgaagatgtgtcggtttatacgtgtcagcagtattatgttactctcactagtttgccacggggtaccaagcgtaggagactcgacgacgaacgtggtcggctgcaccatcg

SEQ ID NO: 338259 - DNA, 496 bp, Homo sapiens
  misc_feature: GZ8MTXP02HVO0R.38.20.B09.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccagacagcctcctaagctgctcgttacnggcctctaccgggatccggggtcctgaacgattcagtggcggcggtctgggacagatttcactctcaccatcagcagcctgcggctgaagagtgtgtcggtttatactgtcagcagtattatgtactctcactagtttgccagggaccaagctgacgatcgacacgaacgtgacgctgcaccatc

SEQ ID NO: 338260 - DNA, 536 bp, Homo sapiens
  misc_feature: GZ8MTXP02FP950.38.20.B09.1.454.CMB.2.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtntttanacaactcaaagaataagagttcttagcttggtaccagcaagaaaccacgacagccctacctaagctgctcgtttacncggccctcgtacccgggaatcccggggcctgaacgattcagtcggcggcggtcgtgggcagtatttcacttctacaccatcagcacgcctggcgggctagaagagtgtaggtcggtttattactgtcagcagttattatgttactctacactagtttgaccgtacgggaccgtaagcgtaggagtacgtcgacacgaacgtcggtggctcgacaccattcg

SEQ ID NO: 338261 - DNA, 493 bp, Homo sapiens
  misc_feature: GZ8MTXP02F2SHA.38.20.B09.1.454.CMB.2.raw
  modified_base (238)..(238): a, c, t, g, unknown or other
  misc_feature (238)..(238): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaagctgctcgtttactggcctctacccgggaatccggggtcctgaacgattcagtggcgcggtctgggcagatttcactctcaccatcagcagctgcggctgaagatgtgtcgttattactgtcagcagtatatgttactctcactagtttgccgtagggacagcgtggagactcgcacgaacgtgtgctgcacatcg

SEQ ID NO: 338262 - DNA, 553 bp, Homo sapiens
  misc_feature: GZ8MTXP02JSIEH.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaaagaataagagttcttagcttggtaccacaagaaaccacgacagcctcctaagctgctcgtttacnggcctcgtacccggatcccggggtcctgaacgnttccgagtggcggcgggtctggggacngtatttcactctcaccatcagcagcctgcgggctagagagtgtgggtacgtttattactgtcagcagttattatcgttactcctctacgttaggtttcggaccggtaacggggtaccaacggcgtacgggaagtacgtcggacaacggtaactggtacggcgtcggccaccacgtcttcg

SEQ ID NO: 338263 - DNA, 510 bp, Homo sapiens
  misc_feature: GZ8MTXP02IUZA6.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccacgacagcctactaagctgctcgttacnggcctcgtaccggatccggggtcctgaacgatcagtggcggcggtctgggcagtacttcactctcacatcagcagcctgcggctagaagagtgtggtcgtttatactgtcagctagtattatgttactctctactagtttgccgtaggggaccaaggcgtaggagacgtcgacacgaacgtgtcgctcgcactatcg

SEQ ID NO: 338264 - DNA, 553 bp, Homo sapiens
  misc_feature: GZ8MTXP02JMF0W.38.20.B09.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagagttcttagcttggtaccagcaagaaaccacgacagcctacctaagctgctcgtttacngggccctcgtacccgggatcccggggtccngaacgtnttcagtgggcggcgggtctggggacctagtatttccactctacaccatcagcacgcctggcggctagaagtagtggtggtacggtttattacgttgtacagctagttattatgttacctctactacgttagtttcggaccgacggggacaaggtcgtaggacgtatccgacaacgtaacgtgacgtctagccaacctctcg

SEQ ID NO: 338265 - DNA, 505 bp, Homo sapiens
  misc_feature: GZ8MTXP02F0RFA.38.20.B09.1.454.CMB.2.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaagctgctcgtttacnggccctcgtacccgggatccggggtcctgaacgattcagtggcgcggtctggggcagatttcactctcaccatcagcagcctgcgggctgaagagtgtggtcggtttattactgtcagcagtattatgttactctcactagtttgcgtacgggaccaagcgtggagacgtcgcacgaacgtgtgctgcacactc

SEQ ID NO: 338266 - DNA, 523 bp, Homo sapiens
  misc_feature: GZ8MTXP02HOBU0.38.20.B09.1.454.CMB.2.raw
  modified_base (239)..(239): a, c, t, g, unknown or other
  misc_feature (239)..(239): n is a, c, g, or t
  modified_base (482)..(482): a, c, t, g, unknown or other
  misc_feature (482)..(482): n is a, c, g, or t
  modified_base (507)..(507): a, c, t, g, unknown or other
  misc_feature (507)..(507): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctctaagctgctcgtttactgggcctcgtacccgggaatccggggtcctgacgattcagtggcggcggtctgggcagatttcactctcacatcagcagcctgcggctgaagatgtggcgtttattactgtcagctagtattatgttactcctctacttaggtttcgacgacggggtaccagtcgtagganacgtcgacaacgtaacgtggcggcngtaccaccgtattccg

SEQ ID NO: 338267 - DNA, 530 bp, Homo sapiens
  misc_feature: GZ8MTXP02FVYEJ.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcaagaaaccacgacagcctcctaagctgctcgtttacncgggcctcgtacccggggaatcccggggtcctagaacgattcgagtggcggtcgggtctggggacagatttcactctcaccatcagcagcctgcggctgaagagtgtggcgtttatactgtcagctagtattatgttactcctcacgtagtttcgacgacggggaccaaagtcgtaggagacgtcgcaacgaacgtgtcggctcggacaccattccg

SEQ ID NO: 338268 - DNA, 536 bp, Homo sapiens
  misc_feature: GZ8MTXP02JYH97.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttacnggcctcgtacccgggatcccggggtcctgaacgcttcgagtggcggcggtctggggcagatttcactctcaccatcagcacgcctggcgggctggaagagtggtgtcggtttattacgtgtcagcagtattagtcgttactctcactagtttcgaccgtacggggaccaagcgtaggacgtacgtcgacgacgaacgtcggtcggctacgcctaaccattccg

SEQ ID NO: 338269 - DNA, 538 bp, Homo sapiens
  misc_feature: GZ8MTXP02HHRRK.38.20.B09.1.454.CMB.2.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggagggccacgatcaactgcaagtccagccggattgtttanacaactcaagaatagngttcttagctggaccngcagaaaccngacagcctcaagctgcttcgttacncggccctcgtaccgggatcccggggtcctgaacgntcgagtcggcggcggtcngggacngtacttcactctcaccntcagcacgcgtggcgggctagaagtagtggtggtcggtttatacgtgtcagtctagttattatcgttactctactacgttagtttcggaccgacgggaccaaggtcgtaggacgacgtcgacgaacgaacgtgtcggctacgcctaccagttccg

SEQ ID NO: 338270 - DNA, 517 bp, Homo sapiens
  misc_feature: GZ8MTXP02GYFDK.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccacgacagcctctaagctgctcgttacnggcctcgtacccgggatccggggtcctagaacgattcgagtggcggcggtctgggcagatttcactctacaccatcagcagcctgcgggctaggaagagtgtggtcgtttattactgtcagctagtattatgttactctctactagtttcgcgtacgggaccaagcgtaggagacgtcgcacgaacgtgtcgactgccaccatcg

SEQ ID NO: 338271 - DNA, 524 bp, Homo sapiens
  misc_feature: GZ8MTXP02G4K7V.38.20.B09.1.454.CMB.2.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccacgacagcctactaagctgctcgtttacnggccctcgtaccgggaatccggggtccctgaacgacttcgagtggcggcggtctgggcagtatttcactctcaccatcagcacgcctgcgggctgaagagtgtggtcgtttattacgtgtcagctagttattatgttactctctactagtttcgcgtacgggaccagcgtaggagacgtcgactacgaacgtgtacggtctgaccacatcg

SEQ ID NO: 338272 - DNA, 517 bp, Homo sapiens
  misc_feature: GZ8MTXP02I67AL.38.20.B09.1.454.CMB.2.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (348)..(348): a, c, t, g, unknown or other
  misc_feature (348)..(348): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccacgacagcctcctaagctgctcgtttacngggcctcgtacccggaatccggggtcctgaacgnttcgagtggcggcggtctggggacagatttcactctcaccatcagcagcctgcggctgaagatgtggtcgtttatacgtgtcagctagtattatgttactcgtcactagtttgccgaggggtaccaagcgtaggagtacgtcgacacgaacgtgtcggctgcaccatcg

SEQ ID NO: 338273 - DNA, 502 bp, Homo sapiens
  misc_feature: GZ8MTXP02H51XT.38.20.B09.1.454.CMB.2.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagtcgatcacgtcacgaccggtgctcgatttagtgtagtgtgaaggggagctacaacaggcaggcagggcagcaagatggtgttgcagacccaggtcttcatttctctgttgctctggatctctgttactacaggtgcctacgggacatcgtgatgacccagtctccagactcctggctgtgtctctgggcagagggccacgatcaactgcaagtccagccggagtgttttanacaactccaaagaataagngttcttagcttggtaccagcaagaaaccagacagcctcctaagctgctcgtttacnggcctctaccggatcccggggtcctgaacntcagtggcggnggtctgggcagtatttcgactcncacntcagcagctgcggctgagatgtgcgttattctgtcgtagcagtattatagttactcctctactagtttcgacgtacggaccgtaagctaggacgagtcgcacgaactgtagcgtgcacctatcg

SEQ ID NO: 338274 - DNA, 509 bp, Homo sapiens
  misc_feature: GZ8MTXP02F62SK.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaaagctgctcgtttacngggccctctacccgggaatccggggtcctgaacgattcagtggcggnggtctggggacagatttcactctcaccatcagcagcctgcggctgaagatgtggcgtttatactgtcagcagtatattntactctnactagttcgacgacggacagcgtaggacacgtcgacaacgtaacgtggtcgcacgacacatcg

SEQ ID NO: 338275 - DNA, 508 bp, Homo sapiens
  misc_feature: GZ8MTXP02F50FW.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaagctgctcgtttacngggccctctacccgggatccggggtccctgaacgnttcagtggcggcgggtctggggacagatttcactctcaccatcagcagctgcggctgaagatgtgtcgtttattactgtcagctagtattatgttactctcactagtttcgcgtacgggaccaagctaggagtactcgcacgaacgtgtacgctgcacatc

SEQ ID NO: 338276 - DNA, 579 bp, Homo sapiens
  misc_feature: GZ8MTXP02G5DMI.38.20.B09.1.454.CMB.2.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccacgacagcctcctaagctgctcgtttacnggccctcgtacccggatccggggtcctgaacgntcgagtggcggcggtctgggcagtnttcactctcaccatcagcagcctgcggctagaagtagtgtcggtcgtttattacgtgtcagtctaggttaattagttacgttaacctcctactacgttaggttttcggccgtaacgggggacccaaaggtccgtagggacgtacgttccggaccgtaaacggtaaccgttgggtacggtccgttacggaccctacctaacgtttccg

SEQ ID NO: 338277 - DNA, 593 bp, Homo sapiens
  misc_feature: GZ8MTXP02HDZS7.38.20.B09.1.454.CMB.2.raw
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
tcagtcgatcacgtcacgaccggtgctcgatttagtgtagtgtgaaggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggancgttttaanacactcaagaatagattcttagcttaggaccagacaacgaaaccacgacagcctactaagctgcttcgtttacgcggccctcgtaccggacgtccggggtcctaggaactcttcgaggtcgggcggtcgggtcgtacggggactagtactttccactcctacacctatacagcacgccgtggcgggctaggaagtagtgggttacggtacggtttattacgttgtacgagtacgtagttaattagttacgttacctcctactacgttaggtttacggaccgtaacggggaccgtaagtcgtaggacgtacgtacgacgaacgtaacgtcggacggtctacgacctactactcg

SEQ ID NO: 338278 - DNA, 551 bp, Homo sapiens
  misc_feature: GZ8MTXP02HDGTF.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaaagaataagagttcttagcttggtaccagcagaaaccagacagcctcctaagctgctcgtttacngggccctcgtacccgggaatcccggggtccctggaacgacttcgagtcggcggcgggtctggggacagtatttcgactctcaccatcagcagctgcggctgaagatgtgtcgtttatactgtcagcagttattagtcgttactctcacgttagtttcggccgtaacggggaccaaggtcgtaggaagacgtacgaccgaacgtaaccgtggtacggtctcggaccaacccgtatttccg

SEQ ID NO: 338279 - DNA, 529 bp, Homo sapiens
  misc_feature: GZ8MTXP02JL14D.38.20.B09.1.454.CMB.2.raw
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactcaagaataagagttcttagcttggaccagcaagaaaccagacagcctctaagctgctcgtttacngggccctcgtacccgggaatccggggtcctagaacgacttcgagtcggcggcgggtctggggacaggtactttcgaccttctacaccatcagcagcctgcggctgaagagtgtggtcgtttattactgtcagctagtattatgttactcctcacgtagtttcgcgtacgggaccaagcgtggagacgtacgacacgaacgtgtcggctcgccactactcg

SEQ ID NO: 338280 - DNA, 635 bp, Homo sapiens
  misc_feature: GZ8MTXP02G4K58.38.20.B09.1.454.CMB.2.raw
  modified_base (246)..(246): a, c, t, g, unknown or other
  misc_feature (246)..(246): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcgaggacgggccacgatcaactgacaagtccaggccggtagttgtttanaacaactacaaagaataagtattcttagcttaggaccagcaagaaaccacgacacgccctactaagctgtccttacgtttacgcgggccctaccggtacccggggtaacgtccccggggtacctaggaacgtacttccgagggtcgggcgggtcgggtcgtaggggactagtactttccacttccgtacacctatacagccacgccgtcggcgggtacgtaggaagtagttggtacgggttcgtttaaacgttcgttgtacagtactagttattacgttgttacctcctactacgttaggtttcggacggtaacggggtaccgaagtccggtaggtacgacgtaccgacgtaacgtaacgtggtacggtctacggacctacacgttccg

SEQ ID NO: 338281 - DNA, 603 bp, Homo sapiens
  misc_feature: GZ8MTXP02G7X2S.38.20.B09.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggcgagagggccacgatcaactgcaagtccagccggagtgtttanacactcaagaatagagttcttagcttggtaccagacaagaaaccacgacagcctactaagctgctcgttacnggccctcgtacccgggatccggggtcctaggaacgacttcgagtcgggcggtcgggtcgtgggactaggtactttccgaccttctacaacccgatacacgccacgcccgtggccggggactaggaagtagtggtacggtacggttttagttacgttgtacagtactagttattacgttcgtttacctcctactacgttaggttttcggaccggaacggggtaccgaaaggtcgtaggaacgacgtaccgacgtaacgaacgttggtacggtctacggacaccgtagtttccg

SEQ ID NO: 338282 - DNA, 499 bp, Homo sapiens
  misc_feature: GZ8MTXP02JB745.38.20.B09.1.454.CMB.2.raw
  modified_base (239)..(239): a, c, t, g, unknown or other
  misc_feature (239)..(239): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctctaagctgctcgttactggcctctaccgggaatccggggtccctgaacgattcagtggcggcggtctgggcagatttcactctcaccatcagcagcctgcgggctgaagatgtggcggtttatactgtcagcagtatatgttactctcactagtttgccgtaggggaccaagctggacgatcgcacgaactgtggctgcaccatc

SEQ ID NO: 338283 - DNA, 516 bp, Homo sapiens
  misc_feature: GZ8MTXP02FU7M9.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctctaagctgcttcgtttacngggccctcgtacccgggaatccggggtccctgaacgattcagtggcggtcgggtctggggcagtactttcactctcaccatcagcagcctgcgggctgaagatggtgtcggtttattactgtcagctagtattattgttactctcatagtttcggctagggaccaagcgtaggagactacgcacgaacgtggtggctgcacatc

SEQ ID NO: 338284 - DNA, 516 bp, Homo sapiens
  misc_feature: GZ8MTXP02GD1S9.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcaagaaaccacgacagcctctaagctgctcgtttacnggccctctacccgggaatccggggtcctgaacgattcagtggcggcgggtctgggcagatttcactctcaccatcagcagctgcggctgaagagtgtggtcgtttattactgtcagcagtattatgttactctctactagtttcgcgtacgggaccaagcgtaggacgacgtcgacaacgaacgtgtcggcgtgacaccattcg

SEQ ID NO: 338285 - DNA, 707 bp, Homo sapiens
  misc_feature: GZ8MTXP02ICGRC.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagacgggccacgatcaactgacaagtccagccggagttgttttanacaactccaaagaataagattcttagcttggtaccagcaagaaaccagacagccctacctaagcctcgtcgttcgtttacggcgtccctaccggtaaccggtacggtcccggtaccacgactccgtacgaggtcgggcgggtcggttcggacggacgagtttacttccgtaccttcctaccacctacacgacgacgtcgtccgtcggggccgtataagggaaagttcggtgggttcgggtttaacgttttaacgttcgtaccgtagtacgtacgttaaggtttatttaacggtttacctttaccttcccgtacgttaacggttttacgggtttacccgggaaaccgggtaacggggaaacccgttaggaccggttaaggggaacgttaccggccgtaaacccgaacgggttaaaccggttggaccgggttacccgtacccgtacccgttaacgtttacgttccg

SEQ ID NO: 338286 - DNA, 542 bp, Homo sapiens
  misc_feature: GZ8MTXP02F7TUV.38.20.B09.1.454.CMB.2.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagagttcttagcttggtaccagcaagaaaccacgacagcctcctaagctgctcgtttacncgggccctcgtacccggggaatcccggggtcctagaacgattcgagtgggccggcgggtctggggacagactttcacttctcaccatcagcagcctgcggctagaagagtgtggtcgtttattacgtgtcgagcagttattatgttactctcacgtagtttcggaccgtaacggggaccaagcgtaggagtacgtacgacaacgaacgtgtacgctcgacactactcg

SEQ ID NO: 338287 - DNA, 515 bp, Homo sapiens
  misc_feature: GZ8MTXP02JJG0U.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
  modified_base (473)..(473): a, c, t, g, unknown or other
  misc_feature (473)..(473): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttaggtaccagcaagaaaccacgacagcctctaagctgctcgttacnggcctcgtaccgggatccggggtcctagacgacttcagtggcggcgggtctgggacnggtattcgtactctcaccatcagcagctgcggctgaagatggtcgtgtttatactgtcagctagtattatcgtactctcacgtgtttgcgtagggaccaaggcnggacgacgtacgacgacgtaacgtgtcgactcgcaccattcg

SEQ ID NO: 338288 - DNA, 512 bp, Homo sapiens
  misc_feature: GZ8MTXP02J1UWG.38.20.B09.1.454.CMB.2.raw
  modified_base (239)..(239): a, c, t, g, unknown or other
  misc_feature (239)..(239): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaagctgctcgttactgggcctcgtacccgggatccggggtccctgaacgattcagtggcggcggtcngggacngatttcactctcaccntcagcagcctggcgggctagaagagtggtggtcgtttattactgtcagcagtattatgttactctcactagtttgccgtagggaccaagcgtaggacgatcgcacgaacgtcgtggctcgcaccatc

SEQ ID NO: 338289 - DNA, 545 bp, Homo sapiens
  misc_feature: GZ8MTXP02JVS37.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccagacagcctctaagctgctcgtttacngggcccttacgtacccgggaatcccggggtccctgaacgacttcgagtcggcggcgggtctggggactagatttcactctcaaccatcagcacgccgtggcgggctgaagagtggtaggtcggtttatacgtgtcagctagtattatgttactctctacgtagtttcgccgtacgggaccaagcgtaggagacgtacgacgacgtaacgtcggtacggctcgacaccgattcg

SEQ ID NO: 338290 - DNA, 535 bp, Homo sapiens
  misc_feature: GZ8MTXP02G8JQ1.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatggcccagtctccagactccctggctgtgtctctgggcgagagggccacgatcaactgcaagtccagccggagtgtttanacaactccaaagaataagagttcttagcttggtaccagcagaaaccagaacagcctcaagctgctcgtttacnggccctcgtacccgggatccggggtcctgaacgattcagtggcggcggtctggggcagtatttcactctcaccatcagcagcctgcggctagaagtatgtgtcggtttattacgtgtcagctagttattatgttactcctcactagtttcgccgtacgggaccgaagcgttaggagacgtacgaccaacgaacgtcggtacggtctcggactaccgactttcg

SEQ ID NO: 338291 - DNA, 597 bp, Homo sapiens
  misc_feature: GZ8MTXP02HNZZ2.38.20.B09.1.454.CMB.2.raw
  modified_base (241)..(241): a, c, t, g, unknown or other
  misc_feature (241)..(241): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagtgtttanacaactccaaagaataagagttcttagcttggtaccagacaagaaacccacgacagccctaccaagctgcttcgtttacgcgggccctacgtacccgggatcccggggtcctggaacgcttcgaggtggcgggtcggtctggggcagtatttcactctcaccatcagcagccgtggcgggctaggaagagtggtggtcgtttattactgtactagctagttattatgttactcctactacgttacgtttcggaccggtacggggtaaccgtaaggtccgtagggaacggtacgttacgaaccgtaacgtaaccggttgggtacgggtccgttacggaccctaccgtaactttcccg

SEQ ID NO: 338292 - DNA, 519 bp, Homo sapiens
  misc_feature: GZ8MTXP02HPSIU.38.20.B09.1.454.CMB.2.raw
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggttgcctacggggacatcgtgatgacccagtctccagactccctggctgtgtctcgtgggcgagagggccagatcaactgcaagtccagccggagtgtttanacaatccaagaataagagttcttagctggtacagcagaaaccngacagcctctaagctgctcgttacnggcctcgtaccggatccggggtccagaacgntcagtggcggnggtcngggcngactttcactctcacatcagcagcctggcggctgaaagagtagtggtacggtttattacgtgtcagctagtattatgttactcgtctactagtttcgacgtacgggaaccgaggcgtaggagacgtcgacgacgaacgtgtcggctcgccgacacgtcg

SEQ ID NO: 338293 - DNA, 597 bp, Homo sapiens
  misc_feature: GZ8MTXP02IC0DT.38.20.B09.1.454.CMB.2.raw
tcagtcgatcacgtcacgaccggtgctcgatttagtgtagtgtgaagggggagctacaacaggcaggcaggggcaacaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccggagttgtttatacaactaccaagaataagagttcttagcttaggtaccagcaagaaaccacgacacgcctacctaagctgcttcgttactcgggccctcgtacccgggaagtcccggggtccctagaacgacttccgaggtcgggcgggcggggtcgtggggactggtacttttcacttcctaccacccatccacgcacgcccgtggcgggctagaagtagtggtggtacgtttattacgtgtcagtctagttattagtgttacctctctacgttaggtttcggaccgtaacggggtaaccaaggtcgtaggtacgagtccgacgtaaccggaacgtggtcggcgtcgaccgtacctattccgtcg

SEQ ID NO: 338294 - DNA, 517 bp, Homo sapiens
  misc_feature: GZ8MTXP02JQF8T.38.20.B09.1.454.CMB.2.raw
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcagagggccacgatcaactgcaagtccagccggatgtttanacaactccaagaataagagttcttagcttggtaccagcagaaaccncgacagcctctaagctgctcgtttacngggccctctacccgggaatcccggggtcctgaacgacttcagtggcgcggtctgggcagatttccactctcaccatcagcagcctgcggctgaagatgtggcgtttatactgtcagcagtattatgttactcctcactagtttggccctaaggggtaccaaggctaggagacgtcgcaacgaacgtgtacggctagcaacctactcg

SEQ ID NO: 338295 - DNA, 591 bp, Homo sapiens
  misc_feature: GZ8MTXP02HL3P8.38.20.B09.1.454.CMB.2.raw
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccaggccggagttgttttanacaactaccaaagaataagagttcttagcttggaccagcaagaaaccacgacagccctacctaagctgcttcgtttacgnggccctcgtacccgggatccggggtccngaacgctcgagtggcggcggtcngggacngtattcactcctacaccntcagcacgccgtggcgggctagaacgtagtggtcggtacggtttattacgttgtacgtagtacgtagttattagttcgtttacctaccgttacgtaccgttaggttttacggaccgtagtacgggtaccaaacgtcggtacggtacgacgtacgacgaacgtaacgtacggtcgtacgtcgaccacctacg

SEQ ID NO: 338296 - DNA, 602 bp, Homo sapiens
  misc_feature: GZ8MTXP02JNDCL.38.20.B09.1.454.CMB.2.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttaanacaactcaagaatagnttctagctgacancagaacacgacagcctactaagctgtcttcgttacgcggccctacgtaacccgggtaagtcccggggtcctagaacgtacttcgaggtcgggcgggtcgggtcgtaggggactagtactttcactctacaaccatacagcacgccgtcggcgggcgtaggaagtagtggtacggttacggtttaagttacgtgtacgtagtacgtaagttaattagttacgttaccttacctactaacgttaggtttcggaccggtaacggggtaaccaaggtacgtagggaacgtacgtacgacgaacgaacgtcggtacggcgtacgaccaacctacgtcg

SEQ ID NO: 338297 - DNA, 539 bp, Homo sapiens
  misc_feature: GZ8MTXP02JHH8S.38.20.B09.1.454.CMB.2.raw
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctcctaagctgctcgttactgggccctntacccgggaatccggggtccctgaacgnttcgagtggcggcggtcngggcagtattcactctcaccatcagcacgcctgcggcngaagatggtggtcggtttatacgtgtcgagctagttattattagttactccttcactaggtttgaccggtacggggaacccaaggtccgtaggacgacgtcgcaacgtaacgtggtacggctcgacaccatttccg

SEQ ID NO: 338298 - DNA, 576 bp, Homo sapiens
  misc_feature: GZ8MTXP02F6ELJ.38.20.B09.1.454.CMB.2.raw
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagtgccacgatcaactgcaagtccagccggtagtgtttanacaactccaaagaataagagttcttagcttggtaccagacaagaaaccacgacagcctctaagctgctcgttacncgggcctcgtacccggatccgggtcctagaaccgtattcgagtcggcggcggtctggggacagtatttcactctcacatcagcagccgtgcggctagaagtgtgtggtcgtttattacgtgtcagtactagttacttattcgttaacctccttactacgttacggtttcggaccggtaacgggggaccctaaaggtccgtagggtacgtaacgtccggactaaccggtaaacgtcggtacggcgtacggacctacttacg

SEQ ID NO: 338299 - DNA, 551 bp, Homo sapiens
  misc_feature: GZ8MTXP02HLGZZ.38.20.B09.1.454.CMB.2.raw
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (438)..(438): a, c, t, g, unknown or other
  misc_feature (438)..(438): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggtagtgtttanacaactccaaagaataagngttcttagcttggaccagacaacgaaaccacgacagccctctaagctgctcgtttacncggccctcgtacccggatccggggtcctgaacnctcgagtggcggnggtctgggcngtattcactctcaccntcngcacgctggcggcagaagagtggtggtcgtttattactgtacngactagttattacgtcgttactcctactacgttaggtttcggaccggtacggggtaccagtcgtaggaacgtacgtcgacgacgtaacgtgtacggctcgaccacgtacttcg

SEQ ID NO: 338300 - DNA, 605 bp, Homo sapiens
  misc_feature: GZ8MTXP02IIBL5.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgacaagtccagccggtagtgtttanacaactccaaagaataagtagttcttagcttggaccagacaagaaacccacgacacgccctacctaaagctgcctcgtttaacgcggggtccctccggtaacccggggaatccccggggtccctaggaaacgtacttccgaggtcgggcgggtcgggtcgtaggggacaggtatttccgacttcctacaacctatacacgcacgccgtcggcggcgtagaagagtggtcggtcgtttattacgtgtcagactagttattattgttacctctactacttaggtttcggaccgtaacggggaccaaggcgtaggtagacgtacgaccgtaacgaacgtcggtacggcgtacgaccaactactcg

SEQ ID NO: 338301 - DNA, 577 bp, Homo sapiens
  misc_feature: GZ8MTXP02JUSJ7.38.20.B09.1.454.CMB.2.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagngttcttagcttggaccagcagaaaccagacagcctctaagctgctcgtttacnggccctcgtaccgggaatcccggggtcctaggaactattcgaggtcggccgggcgggtcgtggggactaggtatttccgacttctcaccatcagcagcctggcggctcgaagagtggtggtcggtttattacgtgtacagtctaggttattagttgttacctccttctacgttaggtttcggccgtaacgggggtacccaaaggtccgtaggaacgtacgtaccgacgacgtaaaccgtggtacggtactcggacctaccctattccg

SEQ ID NO: 338302 - DNA, 525 bp, Homo sapiens
  misc_feature: GZ8MTXP02FOV1W.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcaagaaaccacgacagcctctaagctgctcgtttacnggccctcgtaccgggatccggggtcctgaacgnttcagtggcggcggtctgggcagatttcactctcaccatcagcagcgtgcggctgaagagtggtaggtcgtttagttacgtgtcgagctagttattatgttactctcactagtttcggccgtagggaccaagtcgtaggagacgtcgacgaacgaacgtcgtcggctgaccgaccactcg

SEQ ID NO: 338303 - DNA, 664 bp, Homo sapiens
  misc_feature: GZ8MTXP02J3KTJ.38.20.B09.1.454.CMB.2.raw
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcgaggagggccacgatcaactgcaagtccagccggatgttttanacactccaagataagnttcttagcttggtaccagcagaaaccacgacagccctactaagctagctcgttacgcggcctcgtaccgggaatcccggggtaccctggaacgtcttcgaggtcggcgggtcgggtcgtggggacctaggtacttttccacttcctaccaacctatcgaacgccaacgcccgtcgggccgggtacgttaggaaagtagttggggttacggggttacgggttttaattaccgtggttaccagggtacctaaggtttatttaagttccggttttaacctcccttaccgtaccgttagggttttacggggacccgtaacgggggtaacccaaaggtccggttacgggagttaacgtccgaccgtaaccggtaaccgttggtcggcttacggaccctaacctactttcccg

SEQ ID NO: 338304 - DNA, 600 bp, Homo sapiens
  misc_feature: GZ8MTXP02JJEM1.38.20.B09.1.454.CMB.2.raw
  modified_base (239)..(239): a, c, t, g, unknown or other
  misc_feature (239)..(239): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaatagagttcttagcttgaccagcagaaaccngacagcctcctaagctgctcgtttacngggccctcgtacccgggaatccggggtcctaggaacacttcgaggtggacggcggggtctggggacaggtacttttccacgtctacaccctatccagcacgcctagcggggctaggaaagtagtggtacggtcggttttaataccgtgtacgagtacgtaagttattacgtacgttactcctactacgttaggtttacggaccggtacggggtaaacctaaggtcgtaagggaacgtacgtacgaacgaaccggtaacgtggtacggtctacggacctaacgtacgtttccg

SEQ ID NO: 338305 - DNA, 519 bp, Homo sapiens
  misc_feature: GZ8MTXP02GI30V.38.20.B09.1.454.CMB.2.raw
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaaagaataagagttcttagcttggaccagcagaaaccncgacagcctctaagctgctcgtttacngggcctcgtaccgggaatccggggtcctgaacncttcagtggcggcggtcngggcagtatttcactctcaccatcagcagcctgcgggctagaagtatgtaggtcggtttattactagtcgagctagttattatgttactctcactgtttagccgtaagggaccagacgtgagactacgcacgtaacgtgtcggcgtagcacacttcg

SEQ ID NO: 338306 - DNA, 539 bp, Homo sapiens
  misc_feature: GZ8MTXP02JC6SP.38.20.B09.1.454.CMB.2.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcaagaaaccacgacagcctcctaagctgctcgtttacngggccctcgtacccgggaatccggggtccnggaacgnttcgaggtcggcggcgggtctggggactaggtactttcgacttctacaccatcagcagcctggcggctagagatgtggtcgtttatctgtcagcagttattatgttactcctctactagtttcggccgtacggggaccaaaggcgtaggacgacgtcgacacgtaacgtgcggactgacacctagtcg

SEQ ID NO: 338307 - DNA, 576 bp, Homo sapiens
  misc_feature: GZ8MTXP02I874T.38.20.B09.1.454.CMB.2.raw
  modified_base (241)..(241): a, c, t, g, unknown or other
  misc_feature (241)..(241): n is a, c, g, or t
  modified_base (418)..(418): a, c, t, g, unknown or other
  misc_feature (418)..(418): n is a, c, g, or t
  modified_base (499)..(499): a, c, t, g, unknown or other
  misc_feature (499)..(499): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctctgggcgagagggccacgatcaactgcaaagtccagccggagtgtttanacaactccaaagaataagagttcttagcttggtaccagcaagaaaccacgacagcctactaagctgccttcgtttacgtcgggccctcgtacccgggaacgtcccggggtccctaggaaccgacttcgaggtgggacgggtcgggtctggggacctagtactttccactctcaaccntcagcagcctgcgggctaggaagagttggtggtcggtttaattacgtggtctagactagttattaattgttacctccgttnacttaggtttcgaccgtaacgggaccaagtcgtaggagacgtcgacgtagaaccgtggtcggctagcgactacgtcg

SEQ ID NO: 338308 - DNA, 697 bp, Homo sapiens
  misc_feature: GZ8MTXP02GXA3F.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagcgagtgtttanacactcaagaatagagttcttagcttggtaccagacaacgaaaccacgacagccctactaagctgcttcgtttacgcgggccctcgtaaccccggggaacgttccccggggtccctaggaaacctacgttccgaggtcggggaccggggtcggggtcgttacggggactaggtactttccgaaccttcctaccaaacctatacaacgccacgtcccgtggccggggtactaggaaagtacgtgggtggttaccggttttaattaccgttgtacgtacggtacttaaggtttaacttacgtttacgtttacccttaccttaccgtaacgtttacgggttttacgggacccggtaaacgggggtaaccctaaagggtccggttagggaaacgtacgtaaccgaaccgtaaccggtaacgttgggtaacggtcctacggacctaaaccgtactttcccgg

SEQ ID NO: 338309 - DNA, 533 bp, Homo sapiens
  misc_feature: GZ8MTXP02JSE89.38.20.B09.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctctaagctgctcgttacngggccctcgtacccgggaatcccggggtcctaggaacgattcagtgggcggcggggtctggggacagtactttcgactcgtcaccatcagcacgcctggcggctgaagagtggtggtcggtttatactgtcagctagtattatgttactctctactacgtttgccgtacgggaccaagcgtaggagtactcggacacgaacgtgtcggtctagccaccatcg

SEQ ID NO: 338310 - DNA, 607 bp, Homo sapiens
  misc_feature: GZ8MTXP02GSNU7.38.20.B09.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaaagaataagagttcttagcttggtaccagcaagaaaccacgacagcctactaagctgctcgtttacncggcctcgtaccgggatccggggtcctgacgacttcagtcggcggcggtctaggggcagtatttccgacttccgtcaacccatcgagccagcctggcgggctaggaacgagtggtcggtacggttttagttaccgtgtacgtagtacgtagttattagttcgtttactccttaccgtacgttacggttttacgggacccggtaaacgggggtaccgtaaacggtccgttagggaacgtacgtccgaaccgaaccgtaacgttcggtacggtctcggacctaacctagttccg

SEQ ID NO: 338311 - DNA, 530 bp, Homo sapiens
  misc_feature: GZ8MTXP02FV6WD.38.20.B09.1.454.CMB.2.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (348)..(348): a, c, t, g, unknown or other
  misc_feature (348)..(348): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactcaaagaataagagttctttagcttggtaccagcaagaaaccacgacagcctctaagctgctcgtttacngggccctcgtaccgggaatccggggtcctgaacgnttcagtggcggcggtctggggacagatttcactctcaccatcagcagcctgcgggctgaagatggtggtcgtttattactgtcagctagttattagtcgttactcttactacgtagtttcgaccgtacgggaccaagcgtaggacgtacgtcgcaacgaacgtggtacgctcgcaccattcg

SEQ ID NO: 338312 - DNA, 563 bp, Homo sapiens
  misc_feature: GZ8MTXP02JZ6FR.38.20.B09.1.454.CMB.2.raw
  modified_base (245)..(245): a, c, t, g, unknown or other
  misc_feature (245)..(245): n is a, c, g, or t
  modified_base (321)..(321): a, c, t, g, unknown or other
  misc_feature (321)..(321): n is a, c, g, or t
  modified_base (385)..(385): a, c, t, g, unknown or other
  misc_feature (385)..(385): n is a, c, g, or t
  modified_base (426)..(426): a, c, t, g, unknown or other
  misc_feature (426)..(426): n is a, c, g, or t
  modified_base (524)..(524): a, c, t, g, unknown or other
  misc_feature (524)..(524): n is a, c, g, or t
  modified_base (560)..(560): a, c, t, g, unknown or other
  misc_feature (560)..(560): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgagagggccacgatcaactgacaagtccagccggtagttgtttanacaactccaaagtaataagagttcttagcttggtaccagcaagaaaccagacagcctactaagctgctcgtttacncggccctccgtacccgggatccccggggtcctaggaacgtcttcgaggtcgggcggcgggtcgngggactagtatttccactctcacatcagcacgctggcggcnggaaagtgtggtaggtacgtttatacgtgtacagctagttattagtcgttactcctacacgttagtttcggaccgtacgggacctaaggcgtaggacncgtacgactacggaacgtggacgctcggctaccgtntcg

SEQ ID NO: 338313 - DNA, 536 bp, Homo sapiens
  misc_feature: GZ8MTXP02JU68W.38.20.B09.1.454.CMB.2.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (396)..(396): a, c, t, g, unknown or other
  misc_feature (396)..(396): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactccaaagaataagagttcttagcttggtaccagcaagaaaccacgacagccctctaagctgctcgtttacngggccctcgtacccgggaatcccggggtccctgaaccgacttcgagtggcggcgggtctggggcagatttcactctcacntcagcagctgcggctgaagatggtggtcggtttatactgtcagctagtattattgttactcctctactagtttcgaccgtaggggaccaagcgtaggagacgtccgacgaacgtaacgtggtcggctcgccaacacttcg

SEQ ID NO: 338314 - DNA, 567 bp, Homo sapiens
  misc_feature: GZ8MTXP02I02RV.38.20.B09.1.454.CMB.2.raw
  modified_base (240)..(240): a, c, t, g, unknown or other
  misc_feature (240)..(240): n is a, c, g, or t
  modified_base (533)..(533): a, c, t, g, unknown or other
  misc_feature (533)..(533): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaaagaataagagttctttagcttaggtaccagacaagaaaccacgacagcctacctaagctgctcgtttactgggccctcgtaccccgggaatcccggggtccctaggaaccgtattcgaggtcgggcgggtcggggtacgtggggactagtactttccactctacacctatcagcagcctggcgggctaggaagtatgggtggtcggttttattacgtgtcagctagttattattgttaactcctactacttagtttggaccgtacggggaccaagctaggganacgtcgacacgaactggtcggctgccacgtatcg

SEQ ID NO: 338315 - DNA, 563 bp, Homo sapiens
  misc_feature: GZ8MTXP02F2W71.38.20.B09.1.454.CMB.2.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (415)..(415): a, c, t, g, unknown or other
  misc_feature (415)..(415): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgcaagtccagccgagtgtttanacaactccaagaatagagttcttagcttggtacagacaagaaaccacgacacgcctacctaagctgcctcgtttacncggtccctcgtaacccggggtatcccggggtcctagaacgacttcaggtcggcgggtcggtcgtggggaccagtaactttcacctctacacctatcancagcctggcggctagagtacgtgtggtcgtttattactgtcagctagttattatgttactctctagttacggtttgaccgtaaggggtaccaagcgtaggacgacgtacgacaacgtaacgtggtacggtactcgacctaccattccg

SEQ ID NO: 338316 - DNA, 565 bp, Homo sapiens
  misc_feature: GZ8MTXP02HXYNO.38.20.B09.1.454.CMB.2.raw
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
tcagtcgatcacgtcacgaccggtgctcgatttagtgtagtgtgaagggggagctacaacaggcaggcaggggcaacaagatggtgttgcagacccaggtcttcatttctctgttgctctggatctctgttactacaggtgcctacggggacatcgtgatgacccagtctccagacctccctggctgtgtctctgggcgagagggccaacgatcaaactgcaagtccagccggagttgtttanacaactcaaagaataagagttcttagcttggaccagcaagaaaccacganagcctacctaaagctgctgtttacnggcctcgtacccgggaatcccggggtacctgaaacgtnttcccgaggtcggcggcgggtctggggacngtatttcacctctacaccatcancagccgtcgcggctagaaagtgtaggtggtcgtttattacgtcgtcagtacgtagttattagttagttacctcctcgtacgtagtttcggaccgtaacgggtaccaagtcgtacggagacgtacgacgtacgaacgtgagacgtcgcaccatctcg

SEQ ID NO: 338317 - DNA, 514 bp, Homo sapiens
  misc_feature: GZ8MTXP02IXKG3.38.20.B09.1.454.CMB.2.raw
  modified_base (239)..(239): a, c, t, g, unknown or other
  misc_feature (239)..(239): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttactgggccctctacccgggaatccggggtccctgaacgattcagtggcggcggtctgggcagatttcgactctcaccatcagcagccgtgcgggctgaagatgtggcgtttatactgtcagcagtatgatcgagtcggcctcgatcaccttcggaccaggggacacgactacggacaaataaacgactgtcggctcgcaccta

SEQ ID NO: 338318 - DNA, 505 bp, Homo sapiens
  misc_feature: GZ8MTXP02FGPUC.38.20.B09.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaaagaataagagttcttagcttggtaccagcagaaaccacgacagcctcctaagctgctcgtttacngggccctcacccgggaatccggggcctgaacgattcagtggcggcggtctggggcagatttcactctcaccatcagcagctgcgggctgaagatgtggtcggtttattactgtcagcagtattatgttactctcacagttttggccgaggggaccaagcgtggagatcgcacgaacgtgtggctgcaccatc

SEQ ID NO: 338319 - DNA, 550 bp, Homo sapiens
  misc_feature: GZ8MTXP02FT7YY.38.20.B09.1.454.CMB.2.raw
  modified_base (239)..(239): a, c, t, g, unknown or other
  misc_feature (239)..(239): n is a, c, g, or t
  modified_base (428)..(428): a, c, t, g, unknown or other
  misc_feature (428)..(428): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaaagaataagagttcttagcttggtaccagcaagaaaccacgaacagcctcctaagctagcctcgtttactcgggccctcgtaccccggggaactcccggggtccctggaaccgtattcgagtgggcgggcggtcgtggggacagatttcgaccttctcaccatcagcacgcctgcgggcngaagatggtggtgtttattacgtgtcgagtctagttattattgttactctctactagtttcggccgacgggacaagcgtaggagacgtcgacgacgaacgtgtacggtctcgacacctatcg

SEQ ID NO: 338320 - DNA, 550 bp, Homo sapiens
  misc_feature: GZ8MTXP02I76K2.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactcaaagaataagtagttcttagcttggtaccagcagaaaccacgacagcctctaagctgctcgttacgcgggtccctcgtacccgggaagtcccggggtcctaggaacgacttcgaggtcggcgggcgggtcgtggggacagtactttcactctacacatcagcagcgtgcggctagaagagtggtgtcggtttattacgtgtcgagctagttacttattcgttactcctacacgttgtttcggccgtaacggggaccgaagtcgtaggacgactcgcacgaacgtgacggctcgacactattcg

SEQ ID NO: 338321 - DNA, 523 bp, Homo sapiens
  misc_feature: GZ8MTXP02I1VUG.38.20.B09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagattcttagcttggaccagcaagaaaccacgacagcctcctaagctgctcgtttacgngggccctcgtacccgggaatccggggtccctagacgnttcgagtggcggcggtcngggcngtattcactctcacatcagcagccgtggcggcngaagatggtgtacggtttatactgtcagctagtattatgttactctacacgtagtttcggcgtacgggacaagcgtaggacgacgtacgacacgaacgtgtcggctgaccacacttcg

SEQ ID NO: 338322 - DNA, 573 bp, Homo sapiens
  misc_feature: GZ8MTXP02GR8WV.38.20.B09.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccggatgtttanacaactcaaagaataagattcttagcttggtaccagcaagaaaccacgacagcctactaagctgcttcgtttacncggccctccgtacccggggaatccccggggtacctaggaacgtacttccgaggtcgggcgggtcgggtctggggacagtactttcactctacaccatcagcacgccgtggcgggctgaagagtggtggtcgtttattacgtgtcagcgtagttattatcgttactcctactactagtttcggacggtaacgggtaccgaagtcgtaggagtacgtacgacgaacgtaaccgtggtcggtactcgaccacctacttccg

SEQ ID NO: 338323 - DNA, 551 bp, Homo sapiens
  misc_feature: GZ8MTXP02JRJ60.38.20.B09.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
  modified_base (513)..(513): a, c, t, g, unknown or other
  misc_feature (513)..(513): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcaagaaaccagacagcctacctaagctgctcgtttacngggccctcgtacccgggaatcccggggtcctgaacgattccagtcggcggcggggtctggggacaggtatttccacgtctacaccatcagcagcctggacgggctggaagagtagtggtcggtttattacgtgtcagtctagtattatcgttactcctactacgtagtttcgaccgtacggggaccaaggcgtagganacgtcgacaacggtaactggtcgctcgcctaccagtcc

SEQ ID NO: 338324 - DNA, 553 bp, Homo sapiens
  misc_feature: GZ8MTXP02FU2TH.38.20.B09.1.454.CMB.2.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagttgtttanacaactcaaagaataagattcttagcttggaccagcaagaaaccacgacagcctacctaagctgctcgtttacngggccctcgtacccgggaatcccggggtcctagaacgattcgaggtcggccgggtcggtcgtggggcagtactttcacctctacaccatcagcagcctgcgggctagaagagtggtaggtcgtttattacgtgtacgagtctagttattatgttactcctactactagtttcggaccgtacggggaccaaggcgtaggacgacgtacgacacgaacgtgtacggctcgacacctatcg

SEQ ID NO: 338325 - DNA, 685 bp, Homo sapiens
  misc_feature: GZ8MTXP02G4ATG.38.20.B09.1.454.CMB.2.raw
  modified_base (244)..(244): a, c, t, g, unknown or other
  misc_feature (244)..(244): n is a, c, g, or t
  modified_base (322)..(322): a, c, t, g, unknown or other
  misc_feature (322)..(322): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgacaagtccagccggtagttgtttanacaactcaaagaataagagttcttagcttggtaccagacaagaaaccagacagccctcctaagctgcctcgtttacgnggccctcgtacccgggaatccccggggtcctaggaacgtacttcgaggtgggccggtcgggtcgtaggggactagtactttccgaacttcctaccaaccatacacgacgacgccgtcggccgggactaggaaagtagtagggttacgggtacggttttaagttaccgttagtacgtaaggtacttaaggtttaatttaagttacgtttaccttacccttacgttaaccgtttaacggtttttaccggggacccggtaacgggggtaaacccgtaaaggtccggttagggaacggtacgtacccggtaaccgaaaccggtaacgttcgggttcggaccgttacggacctaaccgtacgtttccg

SEQ ID NO: 338326 - DNA, 570 bp, Homo sapiens
  misc_feature: GZ8MTXP02GOD2U.38.20.B09.1.454.CMB.2.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
  modified_base (478)..(478): a, c, t, g, unknown or other
  misc_feature (478)..(478): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgacaagtccagccgagttgtttanacaactcaaagaataagagtctttagcttaggaccagacaagaaaaccacgaacagacctacctaaagctgtctcgtttaacncggggaccctacgtaacccggggaaactcccgggggtcctaggaaaccgtattacgagtgggcggtcgggtcgtaggggacagtatttccaactcctacaccatacagcagcctgcggctagaagtagtgtaggtcggtttaattacgtgtcagntagtattatgtactctacactagtttcgacgacgggaccgaaagcgtaggaacgatacgacaacgaaacgtgtcggcagacacctaattccg

SEQ ID NO: 338327 - DNA, 617 bp, Homo sapiens
  misc_feature: GZ8MTXP02HZT37.38.20.B09.1.454.CMB.2.raw
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagttgttttanacaactccaaagaataagagttcttagcttggtaccagcaagaaaccacgacacgcctacctaagctgcctcgtttacncgggccctcgtacccgggactcccggggtaccctaggaaccgtacttcgaggtcgggccgggtcggggtcgtaggggcctagtactttccgacttcctcacctatcacgcacgccgtggcgggctacggaagtagtggtaggtacggttttattacgtgttcgagtacgtaaggttattagttcgttacctcctctacgtaggtttcgaccggtaacggggtacctaaggtccgtagggacgtacgtaccgacgaaacgtaacgtggttacggctacggacctaccgtacttccg

SEQ ID NO: 338328 - DNA, 658 bp, Homo sapiens
  misc_feature: GZ8MTXP02HV38V.38.20.B09.1.454.CMB.2.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (644)..(644): a, c, t, g, unknown or other
  misc_feature (644)..(644): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaatgcaagtccagccgtagtgtttanacaactcaaagaataagngttcttagctggtaccagcagaaaccagacagcctctaagctgcttcgttacnggccctcgtacccggaacgtcccggggtccctaggaacgtacttcgaggtcggggccggtcggggtctaggggacctaaggttactttccgaaccttcctacaaccctaatccaagccaacgccccgtaggccgggtacttaggaaacgtaagtgggttacggggttacggtttaaactttacgtcgtacgtaagtaccgttaaggtttaattaaggtttccgtttaacccttccccgttataacggttttacgggtttacggaccccgggtaaacggggaccctaaaggccgtaaggggactacgtccgaacgaacggtaagttcggcggtaccncgacctactactcg

SEQ ID NO: 338329 - DNA, 586 bp, Homo sapiens
  misc_feature: GZ8MTXP02ICW8Z.38.20.B09.1.454.CMB.2.raw
  modified_base (241)..(241): a, c, t, g, unknown or other
  misc_feature (241)..(241): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcgagagggccacgatcaactgcaagtccagccggagtgttttanacaactcaagaataagtattcttagcttaggtaccagacagaaaccacgacagcctcctaagctgtactcgtttactggcctcgtaccgggatccggggtcctgacntcgagtggcggcgggtctgggcngtattccacttcnctacatccagctacgccgtaggcggactgaagagtggtggtcggttttattacgttgtcgtagctagttacttagtcgttactcctagtacgtaggttttcggaccgtaacgggggaacacggtacgttacgggaagtacgtaccggacgaaaccggtaacgttggttacggggcttacgggaccctaaacccgttacgtcg

SEQ ID NO: 338330 - DNA, 640 bp, Homo sapiens
  misc_feature: GZ8MTXP02GI8GS.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggtagttgtttanacaactcaaagaataagtattcttagcttaggtaccagacaacgaaacccacgaaccacgaccctacctaaagctcgtccttacggtttacgcgggtcccttaccggtaaccccggggtaacgtccccgggggtaccctaggaacgtacgttccgaggtcgggccggggtcgggtcgtaggggactagtactttccgacttccacaccatcagccacgccgtggcggacgtagaagtacgtggtacggtcgtttattacgtgtacagtactagttaattacgttacgttactacctacgtacgttacggtttcggaccggtaacgggtaccgaaggtcgtaggacgtacgtaccgacgtaacgtaacgtggtacggctacgaccgtacctacttccg

SEQ ID NO: 338331 - DNA, 614 bp, Homo sapiens
  misc_feature: GZ8MTXP02FIHJ2.38.20.B09.1.454.CMB.2.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactccaaagaatagagttcttagcttggtaccagcaagaaacccacgacacgcctactaagctgccttcgtttacncgggtccctaccgtacccggggtaactcccggggtcctaggaacgtcttcgaggtcgggccggggtcggggtctggggaccaggtactttcacctctcaccatcagcacgcctggcgggcaggaagtagtggtgggtcgtttattacgtgtcagtactagttattacgttacgttaccttcctactacgttacggttttacggaccggtaacggggtaaccgaacggtacgtaggaacgtacgtaccgaccgaaccggaaacgtcggtacggtaccgtcgaccaacctacttccg

SEQ ID NO: 338332 - DNA, 597 bp, Homo sapiens
  misc_feature: GZ8MTXP02H6I8H.38.20.B09.1.454.CMB.2.raw
  modified_base (245)..(245): a, c, t, g, unknown or other
  misc_feature (245)..(245): n is a, c, g, or t
  modified_base (456)..(456): a, c, t, g, unknown or other
  misc_feature (456)..(456): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggccacgatcaactgacaagtccagccggtagtgttttanacaactacaagaataagtgttcttagcttaggtaccagaccaagaaaccacgacacgacctacctaagctacgtcctcgtttacgcgggtccctaccgtacccgggaacgtcccggggtaccctaggaaccgtactcgaggtcgggccgggtcgggtcgtggggactaggtactttccgactctcacatcagcagcctggcggctagaagngtggtgtacgtttatcgtgtcagtactagttattagttacgttactccgtatacgtagtttcggaccgtacggggacctagtcggtaggaacgtcgtaccgagaccgtaagtcggtacgacgtacgaccgtactacgttcg

SEQ ID NO: 338333 - DNA, 593 bp, Homo sapiens
  misc_feature: GZ8MTXP02I6TGP.38.20.B09.1.454.CMB.2.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagacgggccacgatcaactgcaagtccagccggagtgtttanacaactcaaagataagagttcttagcttggaccagcaagaaaccagacagcctacctaagctgcttcgtttacngggtccctcgtacccgggatccggggtcccaggaactnttccgagtcggcgggcgggtctcgggactagtctttcacgttctcgaaccatcagcacgccgtcgcggacgtagaagtagtggtaggtcgtttagttacgtgtacgtagtacgtagttattagttacgttactacctacgtacgtacggtttacggaccgtaacggggaccgtaacggtcggtaggtacgtacgtacgacgaacgtaacgtcggtcggtacgtcgaccgaccgtacttccg

SEQ ID NO: 338334 - DNA, 649 bp, Homo sapiens
  misc_feature: GZ8MTXP02HESUC.38.20.B09.1.454.CMB.2.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgttttanacaactccaagaataagagttcttagcttggtaccagcaagaaaccacgacagcctacctaagctgctcgtttacngggccctcgtacccgggatcccggggtcctagaacgcttcgaggtcggcgggtcgggtcgtcggggacaggtactttccacgttctaccgacctataccgacgccacgccgtggccgggtacgtaggaaggtagttcgggtagggttacggttttaacttaccgttaggtaccgtagactaggtttaatttacgttacgtttacctccgtacgtaccgttacggttttacgggacccggtaacggggtaacccgaaggtaccgttagggaacgtacgtaccggaccgtaacggtaacgtcggtcggtacgttcggacctaaccgtacttccg

SEQ ID NO: 338335 - DNA, 607 bp, Homo sapiens
  misc_feature: GZ8MTXP02GEL10.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgacaagtccagccggagttgtttanacaactcaaagaatagattcttagcttggaccagcaacgaaaccacgacagcctactaagctgcttcgtttactcggccctacgtacccggggaatcccggggtacctaggaacgtcttcgaggtcggggccgggtcggggtctggggacctaggtactttccgaccttctaccacctatcgagccacgccgtggcgggtctaggaagtagtggtggtacgtttagtacgtgtcagtcgtaagttattagttcgttacctcttactacgttacggtttcggaccggtacgggtaccgaaggtcgtaggacgtacgtccgacgtaacgtaaccgtggtacggtcgtacgacctaccgtcttaccg

SEQ ID NO: 338336 - DNA, 582 bp, Homo sapiens
  misc_feature: GZ8MTXP02F8AFL.38.20.B09.1.454.CMB.2.raw
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaatagagttcttagcttggtaccagcaagaaaccacgacagcctactaagctgctcgtttacngggaccctcgtacccggggaatcccggggtcctaggaacgatttccgaggttcggccgggtcgggtccgttggggactacgtacttttccgaccgttctccacctatcagtccacgccgtgcgggctagagagtgtggtcggtttattactgtcagactagttattagttgttactctactacgtacgtttggccgtaaggggacctaaggcgtaggacgtacgtaccgacgtacgaacgtggtacggcgtacgaccaccgtacttccg

SEQ ID NO: 338337 - DNA, 700 bp, Homo sapiens
  misc_feature: GZ8MTXP02HEF8W.38.20.B09.1.454.CMB.2.raw
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggccacgatcaactgacaagtccagccggtagtgtttanacaactcaaagatagagttcttagcttggtaccagacaacgaaaccacgacagccctactaagctgcttcgttacncggcctccgtacccgggactcccggggtcctagaacgcttcgaggtcgggccgggtcggtcgtcggggacctaggttactttaccgacgttcctaccaacccgtataccgagacccgtaacggtcccgtacgggcccgggggtacttaggggaaacgttacggttacggggtttacggggttaccgggtttttaaacttacggttcggttacgtacggtacttaaacgggtttaatttacgttacgtttaacccttccgttaccgtaaccgtttacgggttttaccgggaacccggtaacgggggtaacctaacggtacgtaggggaactacgtaccgacgtaaccgaagttggtcggactccgactaccgtagtttccg

SEQ ID NO: 338338 - DNA, 647 bp, Homo sapiens
  misc_feature: GZ8MTXP02G0EFI.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtggggcgagagggccacgatcaactgacaagtccagccggtagttgtttanacaactaccaaagaataagtagttcttagcttggtaccagacaacgaaaccacgacagcctacctaagctgctcgtttacgcggtccctaccggtaacccggggaacgttccccggggtaccctaggaaacgtacgttccgagggttcgggccggggtacggggtcgtaggggactaggtactttccaaccttctacaccgtatcacgcgacgccgtggcggacgtaggaagtagtggtggtacggtttacttacgttgtacagtacgtagttagttaattcgttacctcctacgtacgttacggtttacgggaccggtaacggggaaccgtaacggtacgtagggaacgtacgtacgaccgtaacggtaacgtggtcggctacgacctaccgtacgtttcg

SEQ ID NO: 338339 - DNA, 569 bp, Homo sapiens
  misc_feature: GZ8MTXP02FZWLR.38.20.B09.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (403)..(403): a, c, t, g, unknown or other
  misc_feature (403)..(403): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaatgcaagtccagccggattgttanacaactacaaagaatagattcttagcttggacagcaagaaaccacgacacgcctacaagctgcctgttacgnggccctcgaccgggactccggggcctagacgtacttcgaggtggccggcgggtctagggctagtcttaccgactctacacatcagcacgcgngcggactagaagagttggtaggtcgtttagttacgtgtacgacgtactagttattattcgttactccgtactacgtacggtttcggaccggtaacgggaccgaagcgtaggtacgtacgtacgacgtaacgaacgtcggtacgtcgacgacctacgtacgtttccg

SEQ ID NO: 338340 - DNA, 706 bp, Homo sapiens
  misc_feature: GZ8MTXP02HXZBN.38.20.B09.1.454.CMB.2.raw
  modified_base (249)..(249): a, c, t, g, unknown or other
  misc_feature (249)..(249): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtgggcgaggacgggccacgatacaactgacaagtccagccggtagttgtttanacaactacaaagaataagtagttcttagcttaggtaccagacaacgaaaccacgacacgccctactaagctgcttacgtttacgcggtccctaccgtaccccggggacgtccccggggtacctggaaccgtcttcgaggtcgggccggggtcggggttcgtacggggtactacggttacttttaccacccgttcctacccaaaccctataccgaacgtccgaacgtcccggttcgggccggggtcgtaagggtaaacgtagttgggttacggggtacggtttttaagtttaccgttgtaccgtacgtacgttaagtttaacgtttaacttcgttaaccttcccgttacgtaacgttacgggttttacggacccggtaacggggtaacccgaggtacgtaagggactacgtacggtaccgaacgtaacgttggacggtcctacggacctacctactcg

SEQ ID NO: 338341 - DNA, 620 bp, Homo sapiens
  misc_feature: GZ8MTXP02HFU9A.38.20.B09.1.454.CMB.2.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgaggacgggccacgatcaactgacaagtccagccggtagtgtttanacactacaagaataagtagttcttagcttaggaccagcaagaaaccncgaacagccctactaagctgccttacgtttacgcgggtaccctacgtaacccggggaacgtccccgggggttacccaggtaaacgtagttccgaggtcgggcgggtacggtcgtgggactagtacttccactctacacatcagacacgcgtggcggctagaaggtatggttaggtacgtttaatacgtgtacagatagttattatgttactctacgtacgttacggtttcggaccggtaacggggaaccgaaggtacggtaggaagtaacgttaccgaccgaaacggtaaccgtggttacgggactcgaccccgtacgtaactttccg

SEQ ID NO: 338342 - DNA, 542 bp, Homo sapiens
  misc_feature: GZ8MTXP02GITNL.38.20.B09.1.454.CMB.2.raw
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgttttanacaactccaaagaataagagttcttagcttggtaccagcaagaaaccacgacagcctctaagctgctcgtttacncggccctcgtacccgggatccggggtcctagaacgnttcgagtggcggcggtcgtgggcngtattcactctcacatcancacgctggcgggcgtagaagtagtggtacggtacggtttattacgttgtcgagtctagttattagtcgttactcctctacgtagtttcgcgtacgggacagcgtaggacgtacgtcgacgacgaacgtgcggtctgactacacgtcg

SEQ ID NO: 338343 - DNA, 565 bp, Homo sapiens
  misc_feature: GZ8MTXP02JQ2YV.38.20.B09.1.454.CMB.2.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (374)..(374): a, c, t, g, unknown or other
  misc_feature (374)..(374): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagtgttttaanacaactccaaagaataagagttcttagcttaggtaccagcaagaaaccacgacagcctacctaagctgctcgttacncggcctcgtaccgggatccggggtcctgaacgtctcgagtcggcggtcgggtcnggggacagtactttcactctacactatcagcagccgtggcgggtctagaagtagtgggtggttacggtttatacgtgtcgagtacgtagttattattcgttacctctactacgttaggtttcggacgtacgggacaagcgtaggacgacgtcgaccgaacgtaaccgtggtacggcacgaccaacctctcg

SEQ ID NO: 338344 - DNA, 700 bp, Homo sapiens
  misc_feature: GZ8MTXP02IKWVU.38.20.B09.1.454.CMB.2.raw
  modified_base (247)..(247): a, c, t, g, unknown or other
  misc_feature (247)..(247): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatccaactgacaagtccaagccggtagttgttttanacaactaccaaagaatagtagttcttagcttggtacagacaacgaaaccacgaacacgcctactaaagctcgcttcgtttaacgcgggtaccctaccgtaacccggggaacgttccccggggtaccctaggaaaccgtagttaccgacggttcggggaccggggtcggggttccgtacggggacgtagtaactttcccgaaccttcctacgaaccctagttacccgagacccgaacgtcccgttgggacccggggtcgtacggaaaggtacggttgggttacgggttacggttttaattacccgttgtacgacgtacgtaagttattacgttcgtttaacctctacgtacgttacggtttcggaccggtaacgggtactaaaggcgttaaggacgtacgttacgacctaaacggtaacgttcggtcgaccgtacgacctaccgtactttccgg

SEQ ID NO: 338345 - DNA, 641 bp, Homo sapiens
  misc_feature: GZ8MTXP02I03V4.38.20.B09.1.454.CMB.2.raw
  modified_base (246)..(246): a, c, t, g, unknown or other
  misc_feature (246)..(246): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactcctggctgtgtctcgtgggcgagacgggccacgatcaactgacaagtccagccggtagttgttttaanacaactccaaagaataagtagttcttagcttggtaccagacaagaaaccacgacacgccctaccgtaagctgccttcgtttacgcgggtccctccggtaaccccggggaatccccggggtaccctaggaaccgtacgttcgagggttcgggccgggtcggggttctggggacctaggtactttccgaccttccgtaccaacccgtatcacgccacgcccgtggaccgggctaggaagtagtggtcggttacggtttaagttacgttgtacgaggtactaaggttaatttagttacgttacttccgtactacgttaggtttcggaccgtaacgggaccaaaggcgtaggacgacgtacgacgaacgtaacgtggcggactcgacctacgacttccg

SEQ ID NO: 338346 - DNA, 614 bp, Homo sapiens
  misc_feature: GZ8MTXP02IRKCR.38.20.B09.1.454.CMB.2.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactccaaagaataagagttcttagcttggtaccagacaagaaaccacgacagcctacctaagctgcttcgtttacgngggtccctccgtaccgggaacgtcccggggtcctaggaacgtactcgaggtcgggcgggtcggtcgtggggactagtacttccgactctcaccatccagcacgccgtggcggactaggaagtgtggtcggtacgtttatacgtgtcgtagtacgtagttattacgtacgtttacctcctacgttacgttacggtttcgggacccggtaacgggggaaccctaaggtcgtagggaacgtaccgtacggacgtaacggaacgttcggacggtcgtacgacctaccgtacgtttccg

SEQ ID NO: 338347 - DNA, 543 bp, Homo sapiens
  misc_feature: GZ8MTXP02I03AD.38.20.B09.1.454.CMB.2.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggtagtgtttanacaactccgagaataagagttcttagcttggtaccagcaagaaaccaagacagcctctaagctagctcgtttacnggccctcgtacccgggaactccggggtccctgaacgnttcaggtggcggcggtctggggcngtatttcgactctacaccatcagcagcctgcggctgagatggtgtgtttatactgcagctagtattattgttactcctactacgtagttttcgccgtaaggggccgaaagtccggtaggagtactacggcctaaacggaacgttggtacgcgtcgcacctagttccg

SEQ ID NO: 338348 - DNA, 676 bp, Homo sapiens
  misc_feature: GZ8MTXP02GULV9.38.20.B09.1.454.CMB.2.raw
  modified_base (246)..(246): a, c, t, g, unknown or other
  misc_feature (246)..(246): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgaggacgggccacgatcaactgcaagtccagccggtagttgtttanacaactaccaagaataagtgttcttagcttggtaccagacaacgaaaccacgacagccctacctaagctgtccttacgtttacgcgggtccccttacggtaacccggggaacgtccccggggtaccctaggaaacgtacttccgaggtcggggcgggtcggggtcgtaggggactaggtactttccacctccgtaccaaccgatacacgtccacgtcccgtagggccgggtacgtaggaaagtagttcgggttacgggttacggttttaattaacgttggtactaggtacgtaagtttaattacgttacgtttacctaccttactaccgttaggttttacggacccggtaacggggtacctaacggtcgtagggaacgacgtaccgacgaacgtaacgtcggtacgtcgtacgacctaaccgtatttccg

SEQ ID NO: 338349 - DNA, 660 bp, Homo sapiens
  misc_feature: GZ8MTXP02JOT9C.38.20.B09.1.454.CMB.2.raw
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggtagtgtttanacaactccaagaataagagttcttagcttaggaccagcaagaaaccngacagcctactaagctgcttcgttacgcggccctcgtaccgggatcccggggtccctaggaacgtacttcgaggtcgggccggtcgggtctggggacctaggtatttccacttccgtaccacctatcacgccgacgccgtggccgggacgtaggaagtagtggtacggttacggtttaattaccgttggttaccgagtacgtaaggttaactttagttacggtttaaccttccgttacgttaaccgtttacggttttacgggaccggtaaacgggggtaacccgaaacgggtaccggtaggtaacggtaacgttaccggaaccgtaacggtaaaccgttggtacggtcgtacgaccgtacccgtatttccg

SEQ ID NO: 338350 - DNA, 613 bp, Homo sapiens
  misc_feature: GZ8MTXP02F9T3G.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgacaagtccaggccggtagttgtttanacaactcaaagaataagtagttcttagcttggtaccagacaagaaaccacgacacgccctactaagctgccttcgtttacgcgggccctccgtacccggggaactcccggggtccctaggaaccgtcttcgagggtcgggccgggtcgggtcgttaggggacaggtactttccgaccttcgtacaccatcagcacgcgtaggcggctaggaagtagtggtacggtcgtttagttacgtgtacagtctagttattacttcgttactcctactacgtacgtttcggaccgtaacggggaccgaaggtcgtacggacgtacgtaccgacgaacgtaacgtcggtacggtacgtcgacctacctacgttccg

SEQ ID NO: 338351 - DNA, 617 bp, Homo sapiens
  misc_feature: GZ8MTXP02H5VRV.38.20.B09.1.454.CMB.2.raw
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (319)..(319): a, c, t, g, unknown or other
  misc_feature (319)..(319): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactcctggctgtgtctctgggcgagagggccacgatcaactgacaagtccagccggtagtgttttanacaactacaagaataagngttcttagcttggtaccagacaagaaaccacgacagcctacctaagctgcttcgtttacncggcctacgtaccgggaatcccggggtcctaggaacgtctcgaggtgggacgggtcggtcgtgggacaggtacttccgacgttcctcacctatccaacgcacgcccgtggccgggtacgtacggaagtagtgggttggttacgtttacttacgttgtactagactagttagtttactacgttactccttacgtaaccgttaggtttacggaccggtaaggggaaccctaaggtcgtacgggacgacgtacgacgtaacgtaacgttcggaacggtccgtacgacctaccgtacttccg

SEQ ID NO: 338352 - DNA, 627 bp, Homo sapiens
  misc_feature: GZ8MTXP02IX4X4.38.20.B09.1.454.CMB.2.raw
  modified_base (246)..(246): a, c, t, g, unknown or other
  misc_feature (246)..(246): n is a, c, g, or t
  modified_base (437)..(437): a, c, t, g, unknown or other
  misc_feature (437)..(437): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactcccgtggctgtgtctcgtgggcgaggacgggccaacgatcaactgacaagtccagccggagttgtttanacaactcaaagaataagtgttcttaagcgttagtaccagacaaagaaaccacgacagccctactaagctgtccttcgtttacgcggtaccctaccggtaacccgggtacgtcccggggtccctaggaactcgttcgaggtcgggcgggtcggtcgtagggacctagtacttccgaacctctaccgaactanacgacgcacgccgtcggcgggcgtagaagagttcggtaggtacgtttacttagtcgtacgagtactagttaagttacgttacgttacttccgtactacgtttacgtttcgggacgtacggggaacctaggacgtaggacgtacgtacggacgtaacgtaacgtggtcggcgtacgtacctactacttccg

SEQ ID NO: 338353 - DNA, 750 bp, Homo sapiens
  misc_feature: GZ8MTXP02JIOTU.38.20.B09.1.454.CMB.2.raw
  modified_base (250)..(250): a, c, t, g, unknown or other
  misc_feature (250)..(250): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgaggacgggccacgatcaactgacaacgtccaggccggtagttgttttanacaactacaaagaataagtattcttagcttaggaccagacaacgaaaccacgacacgcctacgtaagctgcttcgtttacgcggtccctaccggtacccgggaacgtccccggggtacctaggaacgtcgttacgagggtcgggccggggtcgggtcgtaggggacctagtactttccgaccttacctaccgaacctagtaccgagaccgaccgtccgtcggccgggtacgtaggaaaggtacgttagggttacgggttaacgggttttaacgtttaccgttaggttacgtaacggtaccgttaaaggtttaactttaacgtttaccgtttaaccttcccgttacgttaccggtttacggtttaccgggacccgggttaaacgggggtaaacccgaaggttacggtaacgggggaccgtaacggttacccggaccggtaaacccggttaacgttacggggtccggtaccgttaccggaaccctacccgttacgtttcccg

SEQ ID NO: 338354 - DNA, 521 bp, Homo sapiens
  misc_feature: GZ8MTXP02FP1KU.38.20.B09.1.454.CMB.2.raw
  modified_base (239)..(239): a, c, t, g, unknown or other
  misc_feature (239)..(239): n is a, c, g, or t
  modified_base (310)..(310): a, c, t, g, unknown or other
  misc_feature (310)..(310): n is a, c, g, or t
  modified_base (405)..(405): a, c, t, g, unknown or other
  misc_feature (405)..(405): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggaccagcagaaaccacgacagcctctaagctgctcgtttacngggccctcgtacccgggatccggggtcctgaacgattcagtggcggcggtctggggacagatttccgactctacaccatcagcagcctgcgggcngaagagtgtggtcggtttattactgtcagctagtattatgttactctctactagtttcggcgtacggggtaccaagcgtggacgacgtcgcgacgaacgtcgnggctgcacnctcg

SEQ ID NO: 338355 - DNA, 598 bp, Homo sapiens
  misc_feature: GZ8MTXP02GQEQN.38.20.B09.1.454.CMB.2.raw
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactcctggctgtgtctcgtgggcgagagggccaacgatcaaactgacaagtccaaggccggagttgtttaanacaactcaaagaataagagttcttagcttaggaccagcaagaaaccacgaacagcctactaagctgctcgtttacncgggccctacgtaaccggggtaaactcccgggggtacctaggaaaccgntttaccgaggtcgggcgggtcgggtcgtaggggactaggtaactttcaccttctacaaccatacacgcacgctggcgggactaggaaagagttgtagggtcgtttaagttaacgtgttacgagtacgtaaggttattaattcgttaaccttctactacgtagtttcgacgaacgggaccaagcgtaggagacacgacaacgaacgtcgcggctagacaccagtccg

SEQ ID NO: 338356 - DNA, 590 bp, Homo sapiens
  misc_feature: GZ8MTXP02JUNRX.38.20.B09.1.454.CMB.2.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcgaactgcaagtccagccggatgtttanacactcaagaatagagttctagcttggaccngcagaaaccngacngcctctaagctgctcgtttacnggccctcgtaccggagtccgggtcctagaacgtntcgagtcggcggcggtctgggactagtatttccactctcaccatacagacacgccgtggcggtacgtgaagtagtggtggtacgtttagttacgtgtcgtagactaggttattacttacgttacttcctactaccgttaggttttacggacccggtaacggggtaacccgaaaggtccgttagggaacgtagtaccggacgtaaccggaaccgttcggggtacggtacgtacgacctaccgtacgttcg

SEQ ID NO: 338357 - DNA, 583 bp, Homo sapiens
  misc_feature: GZ8MTXP02INNSZ.38.20.B09.1.454.CMB.2.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactccaaagaataagattcttagcttggtaccagcaagaaaccncgacagcctacaagctgctcgtttacnggccctctacccggatccgggtccngacgtntcgagtggcggcggtcngggcngattcactctacacatcagcacgcgtgcgggactagaagtagtggtcggtacggtttattacgttggtacctagtctagttattattcgttacctccttactacttaggttttcggaccgtaacgggggtaccaaggtccgttagggaacgtacgttacggaccgtaacggtaacgttcggggtacggtacgtcggtacccacgtaactttcccgg

SEQ ID NO: 338358 - DNA, 577 bp, Homo sapiens
  misc_feature: GZ8MTXP02GQEU7.38.20.B09.1.454.CMB.2.raw
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (434)..(434): a, c, t, g, unknown or other
  misc_feature (434)..(434): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaaagaataagattcttagcttggaccagcaagaaaccagacagcctacctaagctgctcgtttacncggccctcgtacccgggtaatcccggggtcctaggaaaccgntttaccgaggtcgggacgggtcggggtcgttcggggaccagtactttcgaccgtctacaaccatccagccacgtcccgnggcggactagaagtagtggtaggtacgtttatacgtgtacagtctaagtattattcgttactcctatacgttagttcggacgtaacggacagtcgtaggacgacgtcgacaacgtaacgtggtacgctacgactacctagtcg

SEQ ID NO: 338359 - DNA, 731 bp, Homo sapiens
  misc_feature: GZ8MTXP02JX6AL.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggtagttgtttanacaactccaaagaataagagttcttagcttggtaaccagacaagaaaccacgacagccctacctaagctgtcttcgtttacgcggggtcccttaccggtaaccccggggaaattccccgggggtaccctaggaaaccgtacttcgaggttcgggccggggtcggggttactggggacctagggtacttttaccaccgttctaccaaccctagtaccacgaccgacggtcccgtagggcccggggtactagggaaacgtaaggttcgggttacggggttacggtttttaaacgttaccgttacggtacgtaacgggtactaggtttaatttacgttaccggtttaccttacccgttactaaccggtttacggttttaccgggacccggtaaacggggtaacccgtaaaggtccgttaagggaacggtaccgttaccgaaccgtaaaccgtaacgtcggtacggtcgttacggacctaccgtactttccg

SEQ ID NO: 338360 - DNA, 577 bp, Homo sapiens
  misc_feature: GZ8MTXP02G2SVK.38.20.B09.1.454.CMB.2.raw
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgacaagtccagccggtagttgtttanacaactcaagaatagattcttagcttggaccagcaacgaaaccacgacagcctactaagctgctcgttacncggccctcgaccggatccggggtcctagaacgtntcgaggtcggcggtcgggtctgggactagtactttccacgttctacgacctatccgagccgacgccgtaggcccggggataggaaacgtgtacgggtaggttaccggttttaattacgtgtacgagtctagttattacgtcgttacctcgtactagttacgtttcggacgtacgggacaaggtccgtaggacgactacgactacgaagtgtacgctacgcacgtctcg

SEQ ID NO: 338361 - DNA, 523 bp, Homo sapiens
  misc_feature: GZ8MTXP02HENBW.38.20.B09.1.454.CMB.2.raw
  modified_base (237)..(237): a, c, t, g, unknown or other
  misc_feature (237)..(237): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactcctggctgtgtctctgggcgagagggccacgatcaactgcaagtccagccgagtgttttanacaactcaagaataagagttcttagcttggtaccagcagaaaccacgacagcctacctaagctgctgtttactggccctcgtacccgggaatcccggggtccctgaacgtattcaagtcggcggcggtctggggccagtnttccacttcncacatcagcanccgtgcggctgaagtagngtggacgtttatactgtcagntagtatatgtactctnactagtttcgcgtaggacctaagcgtaggagacgtacgcaacgtaacgtgtaggctcgaccacctatccg

SEQ ID NO: 338362 - DNA, 659 bp, Homo sapiens
  misc_feature: GZ8MTXP02I689L.38.20.B09.1.454.CMB.2.raw
  modified_base (457)..(457): a, c, t, g, unknown or other
  misc_feature (457)..(457): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagactccgtggctgtgtctcgtgggcgaggacgggccacgatacaactgacaagtccaggccggtagttgttttaacacaactaccaaagaatagagttacttagacttggtaccagacaacgaaaccacgacacgcctactaagctcgtccttacgtttacgcggtcccctacggtacccgggtaacgttccccggggtaccctaggaaccgtacgttacgacgggtcggggaccgggtcggggtacgtagggacctagtactttcgacctcgtccaacctnacacgcgacgcgtcggcgacgtagagtacgtggtacggttacgtttaacgtcgtacgtacgtagtacgtaagttacttacgttacgttacctacgtacgtacgttacggttacggaccggtaacgggtacgaaggtacggtacggacgtacgtaccgtaaccgaacgtaacgtcgtacggtacacgaccgtaccgtacttcg

SEQ ID NO: 338363 - DNA, 720 bp, Homo sapiens
  misc_feature: GZ8MTXP02FXGFE.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggccacgatcaatgacaagtccagccggagttgtttanacaactcaagaatagtagttcttagcttggtaccagacaagaaaccacgacacgtacctacctaagcctgtaccgttacgtttaccgtcggggtacccctaccggttaaccccgggggtaaacttcccccgggggtccctaacgggtaaaccgttaccgtttaccggacggtacggggcccggggtccggggttcttaacgggggacctaacgggttacttttaccaacccttccgttaccgaaaccctagtacgacgaccgacggtcccgtaggccggggtactaggaaagtgtggtagggtacgttttaacgttacgtaggtaccagtacgtaagttaatttacgttacgtttaccctccttacgtaaccgttagggtttccgaccggtaacgggtaacccttaaggccgtagggaaacgtcgtaccggtcaaacgggtaacgttcggacggtcctacgaccctacgtactttcg

SEQ ID NO: 338364 - DNA, 569 bp, Homo sapiens
  misc_feature: GZ8MTXP02FH8BX.38.20.B09.1.454.CMB.2.raw
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctctggcgagagggccacgatcaactgcaagtccagccggagtgtttanacaactccaagaataagagttcttagcttggtaccagcagaaacccacgacagcctcctaagctgctcgtttacgggccctcaccccgggaatcccggggtccngaacgattcgagtggcggcgggtctgggacagatttcactctcaccatcagcagtcngcgggtcngaaagagtgtggtcggtttattacgtgttccaagctaggttattacgttagtttacctcctacactaacgttttcggaccgtacggggaacccaaaggtccgtaggagtacgtcggccaacggaaaccgtggttcgggcttacggcctaaccccgtactcg

SEQ ID NO: 338365 - DNA, 727 bp, Homo sapiens
  misc_feature: GZ8MTXP02H1PMX.38.20.B09.1.454.CMB.2.raw
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccagatcaactgacaagtccagccggagtgttttanacaactccaagaataagtagttcttaagtcttaggtaaccctagacaacgaaacccacgacagaccctacctaagctgccttcgtttacncgggcctcgtacccgggactccggggtccctagaacgtnttcgagtcgggccgggtcgggtcgtagggctaggtactttccgactcctcaacctntaccagcacgcccgtggccgggtacttaggaacggtagttcggggttcggggttacggtttttaaagttaccgttacggttacgtaacggtaccgttaaagggtttattttaacgttaccgggttttaaacccctttcccggttacccgttaaaccggtttaggggtttttcccgggggaaacccggtaacgggggtaaacccctaaagggtccgttaggggaaacgttaacgtcccggaacgtaaacccggtaacgttgggtcggtaccgttacggaacccgttaccgtaactttcccgg

SEQ ID NO: 338366 - DNA, 598 bp, Homo sapiens
  misc_feature: GZ8MTXP02GBLAX.38.20.B09.1.454.CMB.2.raw
  modified_base (242)..(242): a, c, t, g, unknown or other
  misc_feature (242)..(242): n is a, c, g, or t
  modified_base (287)..(287): a, c, t, g, unknown or other
  misc_feature (287)..(287): n is a, c, g, or t
  modified_base (414)..(414): a, c, t, g, unknown or other
  misc_feature (414)..(414): n is a, c, g, or t
  modified_base (582)..(582): a, c, t, g, unknown or other
  misc_feature (582)..(582): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctcctggctgtgtctcgtgggcgagagggccagatcaactgacaagtccagccggtagttgtttanacaactcaagaatagagttcttagcttaggaccagcaagaaaccngacagcctactaagctgcctcgtttacgcggccctacgtaccggggactcccggggtacctaggaactacgttcgaggtcggacggcggttactggggactagtactttcgaccttctacgaacctntacagccagccgtggccggtactagaaagtgtcgggttcggtacgtttaattacgtgtaccgagtactagttacttagtcgttacctcctactacgttacgtttcggaccgtacgggaaccaagtccgtaggacgacgtacgaccgtaacgtaacgtcgtacggtccncgtacacctagtttcg

SEQ ID NO: 338367 - DNA, 620 bp, Homo sapiens
  misc_feature: GZ8MTXP02HHTTV.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgacaagtccagccggtagttgttttanacaactaccaaagaataagtagttcttagcttggtaccagacaacgaaaccacgacacgccctacctaagcctgcttcgtttacgcggtccctccgtaacccgggtatcccggggtccctaggtaacgtactcgagtcgggcggcgggtctgggcagtatttccgactctacacctatcagcacgccgtggccgggactaggaagtagttcggtggtacggtttaattacgttacgtcgtaagtacgttagttattacgttacgtttactccttactacggtttaggtttcgggaccggtaacggggaaccgaaggtcgtagggtacgtaacgtccgacgacgtaacgtgtacgggtctcgcctaactcgttccg

SEQ ID NO: 338368 - DNA, 564 bp, Homo sapiens
  misc_feature: GZ8MTXP02FK8GU.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactcaagaatagattcttagcttggaccagcaagaaaccacgacacgcctctaagctgcttcgtttacgcgggccctccgtaacccggggaacttccccggggtacctaggaacgtacttcgaggtcgggcgggcggggtcctggggaccaggtactttcacgttcctcaccatcacgtcacgtccgtggcgggcagaagtagtggtaggtcgtttattcgtgtcagctagtattatacgttactcctctacgtagtttcggaccgacgggaccagcgtaggacgacgtcgacacgaacgtggacggctcgacaccattcg

SEQ ID NO: 338369 - DNA, 513 bp, Homo sapiens
  misc_feature: GZ8MTXP02JDVJG.38.20.B09.1.454.CMB.2.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (502)..(502): a, c, t, g, unknown or other
  misc_feature (502)..(502): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanaacaactcaaagaataagagttcttagcttggtaccagcaagaaaccacgacagcctctaagctgctcgttacnggccctacgaccggatccggggtacctgaactattcgagtggacggnggtcngggcagtattccatcncaaccntcagcacgcctgcggntagagatgtgtcgttattactgtacagtctagtattattnttactctntagtgttcgacgacggacagcgtagacgacacgacacgaacgtagtcgcncgacactactc

SEQ ID NO: 338370 - DNA, 534 bp, Homo sapiens
  misc_feature: GZ8MTXP02FIISI.38.20.B09.1.454.CMB.2.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
  modified_base (400)..(400): a, c, t, g, unknown or other
  misc_feature (400)..(400): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgagagggccacgatcaactgcaagtccagccggagtgtttanacaactcaaagaataagagttcttagcttggtaccagcaagaaaccacgacagcctctaagctgctcgtttacnggcctcaccgggatccggggcctgaacgattcgagtggcggcggtctgggacagtatttcactctcaccatcagcagctgcggcngaagagtgtggtcgtttattacgtgtcagctagtattattgttactcctactacgtagtttcggaccgtaacggggaccgaaggtcgtaggacgtacgtcgacacgaacgtggtcggctagaccaaccgcttcg

SEQ ID NO: 338371 - DNA, 573 bp, Homo sapiens
  misc_feature: GZ8MTXP02GCSED.38.20.B09.1.454.CMB.2.raw
  modified_base (242)..(242): a, c, t, g, unknown or other
  misc_feature (242)..(242): n is a, c, g, or t
  modified_base (321)..(321): a, c, t, g, unknown or other
  misc_feature (321)..(321): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccggtagtgtttanacaactcaaagaataagagttcttagcttggtaccagcaagaaaccacgacacgcctacctaagctgcttcgtttacgnggcctcgtaacccgggatcccggggtcctagaacgcgttcagtcggcggcgggtctggggcagtactttcactctacacctatcagcacgcctgctaggctagaaagtagtggtggacttagtttactacgtgtcaagtactaagttattatagtacgtctagtacgtacgtttcgggaccggggtaccaaggtccgaggacgaacgtaaccgaaaacggtcgtaggtcgactcggaactacgtacgttccg

SEQ ID NO: 338372 - DNA, 666 bp, Homo sapiens
  misc_feature: GZ8MTXP02GJDB1.38.20.B09.1.454.CMB.2.raw
  modified_base (247)..(247): a, c, t, g, unknown or other
  misc_feature (247)..(247): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgagacgggccacgatcaactgacaagtccaggccggtagttgtttaanaacaactaccaaagaataagtagttcttagcttaggtaccagacaacgaaaccacgaaccagccctacctaagctgccttcgtttaccgcgggtcccttacgtacccggggtaacgttccccgggggtaccctaggtaaccgtacgttcgagggtcgggcgggcgggtccgttaggggactaggtactttcgacctcgtaccactactacgacgaccacggcccgttggggaccggggtacctagggaaaagttcggttacgggttaggggtttacggttttaaactttaaccggtcggtaccgtaagtacgtaagtttatttacgtacgtttacctcgtactagttgttcggacgacggacgagcgtaggactacgcgtaccgaagtaacgtcggtacggtcacgctacctacttccg

SEQ ID NO: 338373 - DNA, 677 bp, Homo sapiens
  misc_feature: GZ8MTXP02JI2LF.38.20.B09.1.454.CMB.2.raw
  modified_base (248)..(248): a, c, t, g, unknown or other
  misc_feature (248)..(248): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtcctccagacctcccgtggctgtgtctcgtgggcgaggagggccacgatcaactgacaagtccagccggtagttgtttanacaactcaaagaataagagttcttagcttaggaccagacaagaaaccacgacagcctactaagctgtccttcgtttacgtcgggtacccttaccggtaccccggggtaacgtccccggggtacctaggtaaccgtacgtttaccgagggttcggccggggtcggttacgtaggggactaggtactttccaccgttctaccacgatacgacgctaccgcgtcggcgggctaggaagtgttggtcggttacgtttatacgtgtacagtacttaagttatttacgttacgtttacctccgttacgtacgtttacggtttcggggaacccgtaacgggggtaaacccaagggtccgttaagggacgttacgaacccgtacgtaaaccggtaacggttggtaccggtccgtacggaccttaacctcgtttcccg

SEQ ID NO: 338374 - DNA, 594 bp, Homo sapiens
  misc_feature: GZ8MTXP02JB8ZR.38.20.B09.1.454.CMB.2.raw
  modified_base (120)..(120): a, c, t, g, unknown or other
  misc_feature (120)..(120): n is a, c, g, or t
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctcnggatctctgttactacaggtgcctacggggacatcgtgatgacccagtctccagactccctggctgtgtctcgtgggcgaggagggccacgatcaactgcaagtccagccggtagtgttttanacaactcaaagaataagtagttcttagcttaggaccagacaacgaaaccacgacagcctactaagctgctcgttacncggtcctcgtaccgggactccggggcctgacgtatcgagtggcggcgggtcngggcagttattccactctcaccatacacgcgacgnggacccgtgcgggactgaagtagtcggtttaggaccggtttagtaacctggtcaggtacttaagtagtttaactcgtttactccttacgtttacgacgtttaggggaccctaagggggaccctaagggacttaggtacggacttaccggactaacggtaacgtcgtacggcctcgactacccgtacg

SEQ ID NO: 338375 - DNA, 718 bp, Homo sapiens
  misc_feature: GZ8MTXP02JCB6C.38.20.B09.1.454.CMB.2.raw
  modified_base (242)..(242): a, c, t, g, unknown or other
  misc_feature (242)..(242): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctcaggatctctgttactacaggtgcctacggggacatcgtgatgacccagtctccagactccctggctgtgtctctgggcgagagggccacgatcaactgcaagtccagccggtagtgttttaanacaactacaaagaataagtagtcaaacttgtacgtacagacaacgaaaccacgacacgcctacgtacgctcgtacgttcgtttacggtccggtaccctaccggtaacccggtaccggttccccgggtaccctaggtaaccgtaccgttacggacggtgggcccggggtcggttcggacgggtacgaacgtttctacctactctacaccnctanacgacgaccgtggaacccgggtccttagggaaccggtagtacgggttaaggtcgggtttttaacgtaccggtttaggtttaaccgaacgggttcctaagggttacgtttaaccgttaggtttaaccttccgtttacgtacccgtacggtttttacggacccgtttaagggggtaccccaaaagggtccgtaacggaggtacgtaccggactaaccggtaacgtcggtaacggtacctcggtaccgtccgtaaacgtccgtacg

SEQ ID NO: 338376 - DNA, 716 bp, Homo sapiens
  misc_feature: GZ8MTXP02GPUF1.38.20.B09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgacaagtccagccggagttgtttanacaactccaaagaataagtagttcttagcttggtaccagcaagaaaccacgacacgcctactaagctgtaccttcgtttacgcgggtccctaccgtaccccggggtaacgtcccggggtcccctaggaaccgtacgtttccgaggttcggggaccggggtcggggtccgttaggggacctaggtaacttttccgaccttcttaccgaaacctataccgagccgacgtccgtcggccggggtactacggaaaggtagttcgggttacggggttacggttttaaacgtttaccgttaggtcgtaacggtacctaaggtttaactttacgttacgtttaaccttccgttaacgtacgtttacgggttttaccgggaacccggtaacggggtaaacccgaacgggtaccggttagggacgtacgtaccgaacgaacggtaacgtgggtacggcgtacgaccctaacgtacgtttccg

SEQ ID NO: 338377 - DNA, 605 bp, Homo sapiens
  misc_feature: GZ8MTXP02HK3F3.38.20.B09.1.454.CMB.2.raw
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggtagttgtttacacaactaccaaagaataagtagttcttagcttggtaccagcaagaaaccacgacagcctacctaagctgcttcgttacgcggccctcgtaacccgggaataccggggtccctaggaacgtacttacgaggtcgggcggtcgggtcgtggggactaggtactttccacgtcctcaacctatacagccacgccgtggccgggactaggaagtagtggtggtacggtttagttacgtgtcgtagtacgtagttattagtcgttactctacgtacgttagtttacggaccggtaacgggtaccaaggtcgtacggacgtacgtcgacgacggtaacgtcggtacggcgtacgaccacgtactttccg

SEQ ID NO: 338378 - DNA, 687 bp, Homo sapiens
  misc_feature: GZ8MTXP02HV74C.38.20.B09.1.454.CMB.2.raw
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgagacgggccagatcaactgacaagtccagccggtagttgtttanacaactaccaaagaataagtnttcttagcttaggaccagacaacgaaaccacgacacgccctactaagctgtccttcgtttacgcggtaccctaccggtaacccggggaacgtccccggggtaccctaggtaaccgtacttccgagggtcgggccggggtcggggtaccgtggggacctaggttaactttccgacccttccgtaccaacctactacgacgaccgacgccgtcggaccggggtacgtaggaaagtagtcgggttacgggttaccggttttattaccgttgtaccgtagtacgttagttaacgtttacgttacgttaccttccgtacgttacgttacggttttacgggaccggtaacggggtaccgtaggtacgtaggacgtacgtaccgtacgaacggtaacgtggtcggtactacgacctacctacgttccg

SEQ ID NO: 338379 - DNA, 554 bp, Homo sapiens
  misc_feature: GZ8MTXP02J0E0Z.38.20.B09.1.454.CMB.2.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (413)..(413): a, c, t, g, unknown or other
  misc_feature (413)..(413): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaaagaataagagttcttagcttggtaccagacaagaaaccacgacagcctacctaagctgctcgttacnggcctcgtacccgggaactccggggtcctagaacgattcagtcggcggcggtctggggacagtatttcactctacacatcagcacgcctgccgggntagaagagtgtaggtcgtttattactgtacagctagttattatcgttaactccgtacacgttagtttcggaccgacggggaacccaaaggcgtaggagtacgtaccgacaacgaacgtggtacggctacggcaacctatcg

SEQ ID NO: 338380 - DNA, 523 bp, Homo sapiens
  misc_feature: GZ8MTXP02G50RG.38.20.B09.1.454.CMB.2.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (432)..(433): a, c, t, g, unknown or other
  misc_feature (432)..(433): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactcaaagaataagagttctttagcttggtaccagcaagaaaaccacgacagcctctaaagctgctcgtttacnggccctntacccgggaatccggggtcctgaacgatcagtggcggcgggtctgggacngatttcactctcaccatcagcagcctgnggcgtgaagatgtggnggtttattactgtnannatattatagttactctcactagtttgtacgacggacgaacgacgtagacgagtacgacaacgaacgtacgtacggtcgtcgacaccactc

SEQ ID NO: 338381 - DNA, 740 bp, Homo sapiens
  misc_feature: GZ8MTXP02HNDS4.38.20.B09.1.454.CMB.2.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccagatcaactgacaagtccagccggagttgtttanacaactcaagaataagngttcttagcttaggtaccagcaagaaaccagacagccctactaagctgccttcgttacgtcggcccttccgtaacccggggtaactcccggggtccctaggaacgtacttcgaggtcggggccgggtcggggtccgttggggacctaggttactttacccgtaacctcccttaccgaaacctactaccgacgaccgacgcccgtcgggtccggggtacgtaggtaaacggtaggttgggttcggggttaccgggtttttaacgtttaaccggttggttaccgtaacggtacgttaaggtttaagtttaacttacggtttaacccgttcccttaccgttaaccgtttcggggtttttacgggacccgggtaaacgggggtaaaccccgtaaaggtaccggttagggaacggtacgttaccggaaccgtaccggtaaaaccgttaggtcggggtacctaccggacctaacccgttaacgttcg

SEQ ID NO: 338382 - DNA, 668 bp, Homo sapiens
  misc_feature: GZ8MTXP02JHTS7.38.20.B09.1.454.CMB.2.raw
  modified_base (397)..(397): a, c, t, g, unknown or other
  misc_feature (397)..(397): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctccgtggctgtgtctcgtgggcgaggacgggccagatacaactgacaagtccaggccggtagttgtttacacaactacaaagtaatagtagttcttagcttaggaccagacaacgaaaccacgacacgccctacgtaacgcgtgtcttcgtttacgcgggccctaccggtaccgggtacgtcccggggtcctagacgtctcgaggcggcggggcggtcnggggactacggtactttccgaccttccgtaccaacctataccgacggccaccggtccgtcgggccgggtacgtaacggtaaagtacgttcgggtagggtttaccggtttaattaccggtggtacgtacgtacgttaggttactttagttaccgtttacctcgttacgtaccgttacggtttcgggaccggttaacggggacctaaggtcgtagggaacgtaccgtacgactaacggtaacgtcgggtacgtctacgctaccgtacgttccg

SEQ ID NO: 338383 - DNA, 605 bp, Homo sapiens
  misc_feature: GZ8MTXP02I92OE.38.20.B09.1.454.CMB.2.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacggatcaactgacaagtccagccggtagttgtttanacaactcaaagaataagattcttagcttaggtaccagcaagaaaccncgacacgcctactaagctgcctcgttacgtcggccctcgtaacccggacgtcccggggtcctaggacgtacttcgaggtcggcgggtcgggtctagggactgtacttccgacctcctacaactatccagccgagtccgtggccgggtactaggaaaggtacgttgggtacggttcggttttaactacgttcgtacaggtctaagttattacgttagttacctccttacgacttaggtttcgacggtaacgggactagcgtaggacgacgtacgactacgtaacgtcggtacggcgtacgacctacactttcg

SEQ ID NO: 338384 - DNA, 578 bp, Homo sapiens
  misc_feature: GZ8MTXP02F32ZU.38.20.B09.1.454.CMB.2.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (439)..(439): a, c, t, g, unknown or other
  misc_feature (439)..(439): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagagttcttagcttggtaccagcagaaaccacgacagcctctaagctagcttcgtttacncgggtccctcgtaccccggggaatccccggggtcctaggaacgtacttcgaggtgggccgggcgggtcgtggggacaggtatttccgactcctcgaccatccagcacgcctggcggctagaagtntggtggtacgtttattacgtgtcagctagttatagttagttactcctactacgtagtttcggaccgtacgggacctaggtcgtagggacgtacgtacgtacgacgtaaacgtcggtacgcgtcgactaccgtactttcg

SEQ ID NO: 338385 - DNA, 567 bp, Homo sapiens
  misc_feature: GZ8MTXP02HTQ2P.38.20.B09.1.454.CMB.2.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggagggccagatcaactgcaagtccagccggagtgttttanacaactccaaagaataagtattcttagcttggtaccagcagaaaccncgacagcctctaagctgctcgtttacgcggcctacgtacccgggatcccggggtccnggaacgtcttcgagtggcggcgggtcgngggcctagtatttccactctcaccatcaagcagcctggccggctagaagagtgtcggtcgtttaatactgtcagcagttattagtcgttactctactacgttacgtttcggacccgtaaggggtaccaggccgttaggaacgacgtcgaaccgacggtaaacgtcggttacgcgtacggccaaccctagttcccg

SEQ ID NO: 338386 - DNA, 670 bp, Homo sapiens
  misc_feature: GZ8MTXP02H350Q.38.20.B09.1.454.CMB.2.raw
  modified_base (241)..(241): a, c, t, g, unknown or other
  misc_feature (241)..(241): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactcctgctgtgtctcgtgggcgagagggccacgatcaactgcaagtccagccggtagttgttttaanactaactaccaaagaataagtagttcttagcttaggtaccagcaacgaaaccacgacacgccctactaagctacgtctacgtttacgtcggtccctaccgtaccgggaaccgtccggggtcccctaggaacgtaccttcgacggttcggggccgggtacggggtcgttcggggactacggtactttacccgactaccttaccaacctactacgaacgcgacgtccgtcggcgggtacgttaggaagagttcgggttgggttcggtttaaactttaccgttaggtacctaggtacgtaaggttaatttacgttacgttaaccttcctacttacgttacggttttacggaccggtaacggggaccgtaaagtccgtaggacgtacgtccgaacgacgtaaacgtcggacgtccgagacccacgtacttccg

SEQ ID NO: 338387 - DNA, 694 bp, Homo sapiens
  misc_feature: GZ8MTXP02IYV3G.38.20.B09.1.454.CMB.2.raw
  modified_base (241)..(241): a, c, t, g, unknown or other
  misc_feature (241)..(241): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactcctggctgtgtctcgtgggcgagagggccagatcaactgacaagtccagccggtagttgtttanacaactaccaaagaataagtagttcttagcttaggtaccagcaagaaacccacgaaccacgccctacctaaagctacgtccttacgtttacgtcgggtccctaccgtaaccccggggtaacgttccccgggggtacccctaggaaccgtacgttccgacgggtcggggccggggaccggggttcgtacggggacctaggtacttttaccgaccttcctaccgaacctataccgacgcaacgcccgtggccgggtactaggaacgtagttcgggtcgggttacgttttaaacgttacgttggtaccgtagtacgttaaggtttaactttacgttcgtttaaccttccgttaacgtaccgtttaggtttacgggacccggtaacggggacctaaaggtcgtaggacgtcgtacgcgtaaacggtaacgtggtacgacgtacgacctactctttcg

SEQ ID NO: 338388 - DNA, 639 bp, Homo sapiens
  misc_feature: GZ8MTXP02ISZ8W.38.20.B09.1.454.CMB.2.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgatctggatctctgttactacaggtgcctacggggacatcgtgatgacccagtctccagactccctggctgtgtctctgggcgagagggccacgatcaactgcaagtccagccgagtgtttanacaactccaaagaataagagttcttagcttggtaccagcaagaaaccacgacagcctcctaagctgctcgtttacncgggccctcgtacccgggaatcccggggtccctagaacgtcttcgagtcgggcggcgggtctggggactagtacttttccaccttccgtacaaccatcagcacgccgtggcgggactcggaaagtagtgggtaggtacggttttattaaccgttgtaccgtagtccgtaaggttaacttaagttacgtttaaccttccctacgttacgttaacggttttcgggaacccggtaacgggggaacccaaaagggtccgttagggaacgacgttaccggaccaaacggtaaacgtcggttcggaccgtaggacctacccgtaatttccg

SEQ ID NO: 338389 - DNA, 540 bp, Homo sapiens
  misc_feature: GZ8MTXP02H5HMQ.38.20.B09.1.454.CMB.2.raw
  modified_base (240)..(240): a, c, t, g, unknown or other
  misc_feature (240)..(240): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
  modified_base (507)..(507): a, c, t, g, unknown or other
  misc_feature (507)..(507): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactcaaagaataagagttctttagcttggtaaccagacaagaaaccacgacagccctacctaagctgactcgtttaacncgggccctctaccgggaatcccggggtccctggaacnttcagtcggcgggcggtctgggcagtatttccactctcacctatcagcagcctagcgggtctgaagatggtgcggtttatacgtgtacagctagtattatgttactctctactagtttcgacgtacgggaccaaagtcgtggagaccncgacgacgaacgtgtcgtctcgaccactactcg

SEQ ID NO: 338390 - DNA, 723 bp, Homo sapiens
  misc_feature: GZ8MTXP02GRRW6.38.20.B09.1.454.CMB.2.raw
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctcccgtggctgtgtctcgtgggcgaggacgggccacgatcaactgacaagtccaggccggtagttgtttaanacaactaccaagaataagtagttcttagcttggtaccagacaacgaaacccncgaacacgtacccctactaagctgtccttaccgtttacgcgggtaccctccggtaacccggggtaacgttccccggggtaccctaggaaccgtacttccgaggtcgggccggggtcgggtccgtaggggacctaggtactttccgaaccttcctaccgaacctataccgacgaccgacgtcccgtggccgggtacgtacggaagtacgttgggttacgggttacggttttagttaccgttgtacgtagtacgtaagtttattacgttacgtttacctccgttacgttacgttacgggtttacgggaccggtaacggggtaccgtaaacgggtccggtagggaacgtaccgtaccggtaaccgtaaccggtaaccgttcgggtcgggtaccgttaccgacccgtaacccgttactttcccgg

SEQ ID NO: 338391 - DNA, 553 bp, Homo sapiens
  misc_feature: GZ8MTXP02FOQVB.38.20.B09.1.454.CMB.2.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagttgtttanacaactcaaagaataagagttctttagcttggaccagcaagaaaccacgacagcctcaaagctgctcgtttacncggcctcgtacccgggaatccggggcctagaacgnttccgagtgggcggcgggtctggggcagatttcactctcacatcagcagcctgcggctagaagagtgtaggtcgtttatactgtcagactagttattacgttagttaccttctctacttacggtttacgccgaacggggacaacggacgtaggagacgtcgacgaacgtaacgtggtacggcgtacgaccgactacttaccg

SEQ ID NO: 338392 - DNA, 648 bp, Homo sapiens
  misc_feature: GZ8MTXP02IMA5W.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccacgactccctggctgtgtctcgtgggcgaggacggccacgatcaactgacaagtccagccggtagttgtttanacaactaccaaagaataagtagttcttagcttggtacagacaacgaaccacgacagccctactaagctcgcttcgtttacgcggaccctacgtaccccggacgttcccggggtcctaggaccgtattcgaggtcggggccggtacgggttctaggggactagtacttaccgacctcctccaacctatcagccacgtccgtggacccgggatacggtaagtacgttgggttacgggttacgttttaaagttaccgttggtacgtagtacttaggtttacttaagttccgtttactcgttactacgtttaggtttcggaaccggttacggggaacctaaggtcgtaggaacgtacgtaccgacgtaacggtaacgtgggtaccgtcgcggtacccacgtacttcg

SEQ ID NO: 338393 - DNA, 672 bp, Homo sapiens
  misc_feature: GZ8MTXP02F9PGG.38.20.B09.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggtagttgtttanacactcaaagaatagattcttagctgtaccagacaagaaaccacgacagccctacgtaagctagtccttcgtttacgtcgggaccccttccggtaacccggggtaacgttccccggggtaccctaggaaacgtacgttccgagggtcggggccgggtcgggttcgtagggacctagtctttcgaccttcgtaccaccatcgagtccacgtccgtagggccggacgtagaaaggtgttgggtacggtacggtttacttacgtggtacagtcgtaatttattaagttccgtttaacgtcccttacgtacggtttacgggttttacgggaacccggaacggggtaccctaaagggtccgttaaggggaactaccggtacgaccgtaaaccggaaggttcggtacggtctaccgtacctaccgtctttaccg

SEQ ID NO: 338394 - DNA, 617 bp, Homo sapiens
  misc_feature: GZ8MTXP02JXYGP.38.20.B09.1.454.CMB.2.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtcgccgtacggggacatcgtgatcgacccagtcctccagacctcccgtggctgtgtctcgtgggcgagacgggccacgatcaactgacaacgtccagcggtagttgttanacactacaagatagtnttcttagcgttagaccanaccaagaaaccacgaccagccctacaacgctcgtcctacgttacgcgggccctaccggtacccgggacgtcccgggtacctaggaacgtactcgaggtcgggcggtcgggtacgtgggactagtactttccaccgttccaccgaaccagtccaacgtccgacggcccgtgggcggtactaggaggtacgtgggttacgggttacgtttagtacgttacgactaggtactagttaattacgtcgttaactctacgtacgttgttacggacgtacgggtacacggtcgaggactcgacgtacgacgtaacgtgcgacgtcgacctacgtacgttcc

SEQ ID NO: 338395 - DNA, 618 bp, Homo sapiens
  misc_feature: GZ8MTXP02GE1XY.38.20.B09.1.454.CMB.2.raw
  modified_base (243)..(243): a, c, t, g, unknown or other
  misc_feature (243)..(243): n is a, c, g, or t
  modified_base (444)..(444): a, c, t, g, unknown or other
  misc_feature (444)..(444): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgcaagtccagccggtagttgtttanacaactccaaagaataagtagttcttagcttaggtaccagcaagaaaccacgacagccctactaacgctgtccttcggtttacgtcgggcccttaccgtaccccggggtacgtcccggggtccctagaaccgtctcgaggtgggcggtgggtctgggcagtacttcgactctcaccatcagcagccgtggcggctaggaangtgtacggtgtttaacttctagtcagtactagttattacgttacgtttacctccttactacgttaggttttcgggacccggtaacgggggtacctaaaggtcggtaagggtaacgtaacgtccgaaccgtaacggtaaccgttgggtcggtacgtcggtacaccgtactttccg

SEQ ID NO: 338396 - DNA, 566 bp, Homo sapiens
  misc_feature: GZ8MTXP02GS5G5.38.20.B09.1.454.CMB.2.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
  modified_base (528)..(528): a, c, t, g, unknown or other
  misc_feature (528)..(528): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgcaagtccagcggtagtgtttanacaactcaaagaataagtagttcttagcttaggtaccagacaacgaaaccacgacagcctacaagctgctgttacnggccctcgacccgggatcccggggtaccagaacgtattcgagtcggacggcgggtctaggggactagtactttaccgactctacacctntacgagcagcccgtggcccggntagaaagtntggtaggtcgtttaatacgtgtanagactagttattactcgtttaccnctacgtattaggttgacccgtagggaaccagtcgaggagtacnccgacgtacgaagtcggtaggcctgaccactacgttcg

SEQ ID NO: 338397 - DNA, 744 bp, Homo sapiens
  misc_feature: GZ8MTXP02IPBXS.38.20.B09.1.454.CMB.2.raw
  modified_base (239)..(239): a, c, t, g, unknown or other
  misc_feature (239)..(239): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtggcgagagggccacgatcaactgcaagtccagccggagtgtttanacaactccaaagaataagtagttcttagcttggtaccagtcaagaaaccacgaacagcctcctaaagctagccttcgtttaacgtcggccctcgtaccccggggaatcccggggtccctaggaaccgtactttccgaggttcgggccgggtcgggtccgtaggggaccgaggttactttccgaaccttccttacaacctatacgacggtaccaacgtcccgttcggcgggggtacctacgggtaaacgtaagttgggttacggggttaccggtttttaaagtttaacccgttgggttacgtacggtaacccgttaagggttaaattttaacgttaccggttttaaaccgtttccctttaacgtacccgtttaaaggtttttcggggaaccccggtaacgggggtaacccgtaaaaggtccggtttaagggaacgtacggttaaaccgccgttaaaccgaaacgttcggtaacggggtacccttggacccaccgtaactttcccgg

SEQ ID NO: 338398 - DNA, 588 bp, Homo sapiens
  misc_feature: GZ8MTXP02IBMJB.38.20.B09.1.454.CMB.2.raw
  modified_base (408)..(408): a, c, t, g, unknown or other
  misc_feature (408)..(408): n is a, c, g, or t
  modified_base (525)..(525): a, c, t, g, unknown or other
  misc_feature (525)..(525): n is a, c, g, or t
  modified_base (588)..(588): a, c, t, g, unknown or other
  misc_feature (588)..(588): n is a, c, g, or t
tcagtcgatcacgtcacgaccggtgctcgatttagtgtagtgtgaagggggagctacaacaggcaggcaggggcagcaagatggtgttgcagaccccaggtcttcatttctctgttgctctggatctctggtgcctacggggacatcgtgatgacccagtctccagactccctggctgtgtctctgggcgagagggccaccatcaactgacaagtccagccagagtgtttacacaggtaccaaacaataagaattacttcgcttggtaccagacaagaaaccagacacgacctactaagtgctctatttacgtggtacactaccgtacccgggaggtcccggggtccctgaccgtatccgacgcgcaggcggtctgagacagtactttcactctacaccatcagcacnccgtgacgaggtctagaagtatggtaggtacttaagtttattacgtgttacgagtataagttatttactaaggttacctaccttagtaacgttacggtttcggggaacccggggtanaaacggtcgtacggaagtaactaaccgaaaacgtacgtagtacggtactacgactaacccgtn

SEQ ID NO: 338399 - DNA, 594 bp, Homo sapiens
  misc_feature: GZ8MTXP02IBUCV.38.20.B09.1.454.CMB.2.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgaccagtctccagactccgtggctgtgtctcgtggggcgaggacgggccagatcaacgtgcaagtccagccgagttgttttanacaactcaagaatagtagttcttagcttaggtaccagcaagaaaccacgacagcctacgtaagctgctcgtttacgnggcctacgtaccggatccggggtcctagaacgtatcgagtcggcggcggtcgagggcagtnttccgactctcacatcacncacgccgtggcccgggtataggaacgtagtgggttacggttaccggttttaaagttccgtggtacgtaaggtactaaggttatttagtcgtttactccttacgtacgttaggtttcggaacgtacggggaacctaggtcctaggggatacgtccggaacacggtaacgtgtcggtaccacgacctactacgtcg

SEQ ID NO: 338400 - DNA, 546 bp, Homo sapiens
  misc_feature: GZ8MTXP02FHL6B.38.20.B09.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggcgagaggccacgatccaactgacaagtccagccggagtgtttanacactcaagatagnttcttagcttggacagcagaaaccncgacacgcctcaagctgctcgttactggccctcgacccgggtaagtcccggggtcctagaacgcttcgaggtggcggtacggtctgggacaggtactttcacttcgacaccatcagcagcctggcggactgaacgagttgtggtacgtttatactgtcatcgtatattactgttaactctactactaggtttcgacgacgggaccaagtctagggactaacgtccgacgtaacggtaaccgttggtacggtcctcgaccacctactcg

SEQ ID NO: 338401 - DNA, 652 bp, Homo sapiens
  misc_feature: GZ8MTXP02IUHVT.38.20.B09.1.454.CMB.2.raw
  modified_base (245)..(245): a, c, t, g, unknown or other
  misc_feature (245)..(245): n is a, c, g, or t
  modified_base (384)..(384): a, c, t, g, unknown or other
  misc_feature (384)..(384): n is a, c, g, or t
  modified_base (546)..(546): a, c, t, g, unknown or other
  misc_feature (546)..(546): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagactccctggctgtgtctcgtgggcgagacgggccacgatcaactgacaagtccagccggtagttgtttanacaactcaaagaataagtattcttagcttggtcgaccagacaagaaaccacgacacgcctacaagctgtcttcgttacgtcgggcctcgtaccccgggaagtcccgggtccagaaccgactcgaggcggcggcgggtcngggggactaggtatttccgactctacaaccatcgacgcaacgccgtacggcggtacctagtaaaggtcgttagggtcggggtttacggttttaaacgtttaccgtacgggtttacaccgggttataacggtttaatttacgttacggtttacctacccgttntaaacgttaggttttacggaccgggaacggggtaactacgggtacgttagggacgtacgttccgaacgtaacgtaacgttggtcggactaccggtacaacgttccg

SEQ ID NO: 338402 - DNA, 681 bp, Homo sapiens
  misc_feature: GZ8MTXP02JGHOQ.38.20.B09.1.454.CMB.2.raw
  modified_base (250)..(250): a, c, t, g, unknown or other
  misc_feature (250)..(250): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctcccgtggctgtgtctcgtgggcgaggacgggccacgatcaactgacaagtccaggccggtagttgtttanacaactaccaagaatagtattacttagcttagtaccagacaacgaaaccacgaaccagccctactaagctgtccttcgttacgtcggtccctacggtacccggtacgtcccggggtcctaggaacgtacttacgaggtcggcggggtccgggtagtcgggactagtactttccgactcctaccaaccactaccgacgtaccgacgccgtcggtccggggtactacggaaggtacggttcggtacgggttacgttttacgttacgttcggtactacggtacgttaggttaacttacgttacgtttaccttaccgttacgtaaccggtttacggtttacgggaccggtaaacggggtaccgaaggtcggtaagggacgtacgtaccggaacgaaccgtaacgtcggacgtcgtacgtactaaccgttacgtcg

SEQ ID NO: 338403 - DNA, 664 bp, Homo sapiens
  misc_feature: GZ8MTXP02JXT6H.38.20.B09.1.454.CMB.2.raw
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggccacgatacaactgacaaagtccaggccggtagttgttttaacactaactccaaagaataagagttcttagcttaggaccagcaacgaaaccacgacagccctcctaagctgacttcgtttacgtcgggccctaccggtaacccgggacgttcccggggtccctaggtaacgtacttccgaggtcggcggtcgggtcgtagggcctagtactttccgactcctacacccatcacgtcacgccgtcggtcggcgtaggaagtcgtagttgggtacgtttagttacgtcgtcgagtccgtagttaattacgttacgttacctacctacttaccgttacggttttacgggacccggtaacggggtaaacccgtaggtaccgtacgggtaacgtacgtaccggaacccgtaaacggtaacgtcggttacggcgttaccgaccgtaccgtaacgtttacccg

SEQ ID NO: 338404 - DNA, 603 bp, Homo sapiens
  misc_feature: GZ8MTXP02FVI1U.38.20.B09.1.454.CMB.2.raw
  modified_base (244)..(244): a, c, t, g, unknown or other
  misc_feature (244)..(244): n is a, c, g, or t
  modified_base (392)..(392): a, c, t, g, unknown or other
  misc_feature (392)..(392): n is a, c, g, or t
  modified_base (433)..(433): a, c, t, g, unknown or other
  misc_feature (433)..(433): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgaggacgggccagatcaactgcaagtccagccggtagttgtttanacaactcaaagaatagagttcttagcttaggtaccagcaacgaaaccacgacagcctacgtaagctgcttcgtttacgcgggccctcgtacccggggtagtcccggggtactagaacgtcttcgaggtcggcgggtcggtcgtgggcngtactttcgacttcacacatcgagcacgcgtaggcggtacngaagtgtggtcgttcggtttaaatcgtcgtcaggtactaaggttattacgttactttaccgtcctaacgtacgttacgtttcggggaccgaacgggggtaccctaaggtccggtaggacgtacgtaccgacaacgggtaacgtggtacggacgttcgactactactttcg

SEQ ID NO: 338405 - DNA, 742 bp, Homo sapiens
  misc_feature: GZ8MTXP02IXTB7.38.20.B09.1.454.CMB.2.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacgggacatcgtgatgacccagtctccagactcctggctgtgtctcgtgggcgagacgggccacgatcaactgacaagtccagccggtagttgtttanacaactacaagaatagtagttnttagcttaggaccagacaacgaaccacgacagccctactaagctgccttcgttacncggtccctcgtacccgggaatcccggggtcccagaacctacgttcgaggtcggccgggtcggtccgtagggacctaggttaactttccgaaccttccgtaccaaccgtactaccgacgaccgaacgtcccggtacgggtccggggtacgtacgggtaaaaggtacggttcgggttacggggttaccggtttttaaacgttaccggttcggtaccgtaaggttaccgttaaagggtttaacctttaaccgtttacggtttacccgttacccttaaccgttaaccggtttaacggttttcccgggaaccgtaaacgggtaacccggtaaaccgtaaacggtccgttaagggtaacgtaccgtaccggtaccgtaaaaccggtacgttcggtacggtccgtaccggtaccgtaaacccgtttacg

SEQ ID NO: 338406 - DNA, 697 bp, Homo sapiens
  misc_feature: GZ8MTXP02FJP74.38.20.B09.1.454.CMB.2.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (688)..(688): a, c, t, g, unknown or other
  misc_feature (688)..(688): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggcgagagggccacgatcaactgcaagtccagccgagtgtttanacactcaagaatanagttnttagcttggtaccagcaacgaaacctacgacacgcctactaaacgctagtccttacgtttaccgtacgggtcccctacgttaacccccgggggtaaacttccccgggggtaccctaggtaaaccggtaactttccgaaggttcggggccggggtccggggtcgttaggggacctaacggtaacgttttccaacgttcctaccaaaccgacgttaccaacggttaccgaacggacccgttacgggcccggggttaccgtagggaacgtaacgttcgggtacgggttaccggggtttaactttaccgtacgttccgaagtccgtaagttactttaacgttcgttaccctacgttaccgacgttaggtttcggaccgtaacggggtaccaaaggccgttaaaggcgtactcgacacggtaacgtggtacgctacncactactcg

SEQ ID NO: 338407 - DNA, 592 bp, Homo sapiens
  misc_feature: GZ8MTXP02HYA4T.38.20.B09.1.454.CMB.2.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
  modified_base (578)..(578): a, c, t, g, unknown or other
  misc_feature (578)..(578): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagcggagtgttttanacaactaccaagaataagagttcttagcttggtaaccagcaagaaaccagacagccctactaagctgctcgtttacncggcctacgtacccgggaatcccggggtccctagaacgtactcgaggtcgggcggcggggtccgtggggccaggtactttaccgactcctcgaccatccagcacgcccgtggccggctaggaagtagtggtcgggttacgtttaattacgtgtacgagtacgtagtattatacgttacctccttacaacgttaggtttcggaccggtaaacggggaccaaggtcgtaggaacgacgtccgacgaacgtaacgtggtacggcncgacctactactcg

SEQ ID NO: 338408 - DNA, 798 bp, Homo sapiens
  misc_feature: GZ8MTXP02J2QRL.38.20.B09.1.454.CMB.2.raw
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtcctccagacctcccgtggctgtgtctcgtgggcgaggagggccacgatcaactgaccaagtccacggtccggtagttgttttaacaccaacctaccaaagtaataagagtttcttagcttaggaccagacaacgaaaccacgacacgtccctacgtaacgcttcgccgtttacggtttacgccggggtaccccttaccggtaaccccggggtaaccgttccccgggggttaccctacggaaaccgtacccgtttacggaggggtccggggccggggttccggggttaccggtaggggtaccgacgggtttaacttttacccgacttaccgtacccaaacccgtacgtacccgacgaccgtaccggtacccgttacggggcccggggttacgtaggtaaacgtcgggttacgggttacgggtttaccggtttttacttaccggttacggttacgtacgttacgttaagtttaaacgtttacgttacggtttaacccttccgttaaccgttaaggtttaccggtttacggggacccggtaacggggtaacccgtaaggcggttacggaacgtacgtaccggacgtaaccggtaacggttcggtcggccgttacgaccgtacctacgtccg

SEQ ID NO: 338409 - DNA, 632 bp, Homo sapiens
  misc_feature: GZ8MTXP02GVA6A.38.20.B09.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgagacgggccacgatcaactgacaagtccaggccgtagttgtttanacaactaccaagaatagtnttcttagcttggacagacaagaaaccagacacgcctactaagctgcttcgtttacgnggtccctcgtacccggacgtcccgggtccagaacncgttacaggtcgggccgggtcggtcgttaggggactaggtatttacccgcgttacctcctaacctataccgacgaccgacgcccgttacggccggggtacgtaggaacgtaggttcgggttacgggtacgttttagtaccgttagtacgtacgtacttagttacgttattacggttactcctacgtacgttagtttcggacgtacgggaccaagtcgtacggacgacgtacgacgtacgaacgtcggtacggtccgtacgacacctacgtttccg

SEQ ID NO: 338410 - DNA, 660 bp, Homo sapiens
  misc_feature: GZ8MTXP02FMKKY.38.20.B09.1.454.CMB.2.raw
  modified_base (237)..(237): a, c, t, g, unknown or other
  misc_feature (237)..(237): n is a, c, g, or t
  modified_base (281)..(281): a, c, t, g, unknown or other
  misc_feature (281)..(281): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcagagggccacgatcaactgcaagtccagccgagtgtttanacaactcaagaatagattcttagcttgaccagacaacgaaaccncgacacgccctactaagcctgtacttacgtttaacgcggtaccctaccgtaacccggggtaacgtccccggggtacctacgaaaccgtactttccgaacgggtcgggccgggtccgggttcgtaggggacctagtaccttttcgaacctccgtaaccactaactcgacgacgacgcgtcggccggacgtagaagtacgttggtagtacggtttaaactttacgttcgtacgtacgtacgtaagttaacttaacgttccgttaacttccgtactacgttacggttttcggaccggtaacgggtaccgaaagtccgtaggaacgtagtaccgacgtaaacgtaaacgttcggtacgtcgtacgacctaccgtaactttccg

SEQ ID NO: 338411 - DNA, 651 bp, Homo sapiens
  misc_feature: GZ8MTXP02G0HZ2.38.20.B09.1.454.CMB.2.raw
  modified_base (245)..(245): a, c, t, g, unknown or other
  misc_feature (245)..(245): n is a, c, g, or t
  modified_base (468)..(468): a, c, t, g, unknown or other
  misc_feature (468)..(468): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccagatcgaactgacaagtccagccggtagtgtttaanacaacctcaaagaatagagttcttagcttggtaccagaccaagaaaccacgacacgtccctaccgtaagctggcctcgtttacgtcggggccctacggttaaccccggggaaacgttccccgggggtaccctggaaaccggtatttaccgacgggtacggggtccggggtcgggttaccgtaggggacctaggtacttttaccgaccttccgtcaaacccgtntacgacgtcgaccgccgtaggcggggctaggaagtgttggtcgtcgtttatacgtgtacagctagttattacgtgttacctccttacgacgttggtttcggaccggtacgggacctaaggcgttaggacgtacgtaccgcgaaaccgtaagtcggtacggtactcggtacaacctacgtttcg

SEQ ID NO: 338412 - DNA, 635 bp, Homo sapiens
  misc_feature: GZ8MTXP02HB237.38.20.B09.1.454.CMB.2.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
  modified_base (440)..(440): a, c, t, g, unknown or other
  misc_feature (440)..(440): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagacgggccacgatcaactacaagtccagccggagttgtttanacaactccaaagaataagngttcttagcttaggaccagcaagaaaccacgacagcctaccaagctgctcgttacncggcctcgtaccgggatcccggggacctagaacgtattccgaggtcggcgggtacggggtctaggggactaggtactttccacgtcctacgacctatccaagccaaggcccgtagggcccgggnttacggaaagtgttgggtacgggttacggttttaattacgtcgttaccaagtcgttaagttactttaagtccgtttaactcccgtataaccgttggtttcgggacccgaaagggggtaacccaagggtcgtagggtacacgtccgacaaccgggtatcgggtcggcttacggcctaaacctgttcccggttaacg

SEQ ID NO: 338413 - DNA, 548 bp, Homo sapiens
  misc_feature: GZ8MTXP02JVN9U.38.20.B09.1.454.CMB.2.raw
  modified_base (240)..(240): a, c, t, g, unknown or other
  misc_feature (240)..(240): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaaagaataagagttcttagcttggtaccagcaagaaaccacgacagccctcctaaagctgctcgtttactgggccctctaaccgggaatccggggtccctgaacgtattcgagtggcggcgggtctggggaccaggtactttcgactcgtcaaccatcaagcacgcctgcgggctagaagtatgtggcgtttaagttactgtcagcagtattatagttactcctcactagttttcgacgtacggggaccaaaggctaggagaacgtcgacacgtaaacgtgtaggactcgacaccattcg

SEQ ID NO: 338414 - DNA, 659 bp, Homo sapiens
  misc_feature: GZ8MTXP02H1KXI.38.20.B09.1.454.CMB.2.raw
  modified_base (276)..(276): a, c, t, g, unknown or other
  misc_feature (276)..(276): n is a, c, g, or t
  modified_base (605)..(605): a, c, t, g, unknown or other
  misc_feature (605)..(605): n is a, c, g, or t
tcagtcgatcacgtcacgaccggtgctcgatttagtgtagtgtgaagggggagctacaacaggcaggcaggggcagcaagatggtgttgcagacccaggtcttcattttctctgttgctctggatctctgttactacaggtgcctacggggacatcgtgatgacccagtctccagactccctgctgtgtctcgtgggcgaggacgggccacggatcaacgtgacaagtccaggccggtagttgtttaatacaactaccaaagtaataaagtagttnttaacgcttggtaaccagtcaaagaaaccacgacaacgcctacctaacgctacgctacgtttacgtcgggaccttccgtaacccgggtacgtccccggggtcctacgaacgtcttacgtacggtcgggaccgggtcgggtcgtacgggaccgtaggttactttccgaacttcctaccaaccacttacgaccgtacgaacgccgtggacggggtaccgtagtaagacgttgggtacggttacggtttattacgtgtactaggactagtacttattcgtctacctcacgttggttcgaccggaggtaacccgagtcggtaggaacgttacnccggaacgttaacgaacgtaggtccggacgttcgaacccgtcttaagttcccgg

SEQ ID NO: 338415 - DNA, 633 bp, Homo sapiens
  misc_feature: GZ8MTXP02FXJYZ.38.20.B09.1.454.CMB.2.raw
  modified_base (250)..(250): a, c, t, g, unknown or other
  misc_feature (250)..(250): n is a, c, g, or t
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagactccctggctgtgtctcgtggggcgaggacgggccacgataccaactgacaagtccagccggtagttgtttanacaactcaaagaatagtagttcttagcttaggaccagacaaacgaaaccacgacacgaccctacctaagctgtcgttcgttacgtcggcccttcgtaccgtacggggaacgtccccggggtcctagtaacccgtnttcgaggtcggcggggtccgggttcgnggggactagtacttccactctacaaccactacgacgacgacgccgtggcgggtcgtagaagtagtgtgggttacggtttattacgtcgtcgtagtacgtagtagttattacgtttaccttcctactacgttacggtttacggaccggtaacggggtaaccgaggtcgtacggtagtacgtccggaaccgtaacgtaacgtaggtcgtacgcgtacacgtac

SEQ ID NO: 338416 - DNA, 681 bp, Homo sapiens
  misc_feature: GZ8MTXP02FK8TQ.38.20.B09.1.454.CMB.2.raw
  modified_base (660)..(660): a, c, t, g, unknown or other
  misc_feature (660)..(660): n is a, c, g, or t
  modified_base (678)..(678): a, c, t, g, unknown or other
  misc_feature (678)..(678): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatgacccagtctccagacctcccgtggctgtgtctcgtggggcgaggacgggccaacgactcgaaactgacgaacgtccaaggtccggtagtttgtttaactaacaacctacaaagaattaaagtgtttacttagacgttggtaaccaggacaaacgaaaccctacgaacacgaccctaccgtaagctcgtcctttacgtttaccggtcggtaccctaccggtacccgggtaacgtccccggggtcctacggaaacgtacttacgaggttgggcccggggtacggtcgtggggacctagtactttccgacctcttacaccgtataccgacgccgacgtcgtacggcggggtactaggaaagtcgtacgggttggttacggtttaacttacgtcgtaccgtaggtacttaaggtatttacgtacgtttacccttcgtaactcgttacggtttcggaaccgtagggacctaagcggtaggacgtacgtacgacgtacgaacgngtacgcacgacaaccgtntcg

SEQ ID NO: 338417 - DNA, 641 bp, Homo sapiens
  misc_feature: GZ8MTXP02FK37U.38.20.B09.1.454.CMB.2.raw
  modified_base (245)..(245): a, c, t, g, unknown or other
  misc_feature (245)..(245): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtggggcgagagggccacgatcaactgacaagtccagccgagttgtttanacaactcaaagaatagagttcttagcttggtaccagacaacgaaaccacgacacgccctacctaacgcgtgtccttcgtttacgtcgggaccccttaccgtaaccccggggaacttccccgggggtacctacggaacgtaccgtttcgaggtcggggccgggtacggggttctaggggacctaagtacgttttaccaccttccgtacaccgaataccagcgacgccgtcggcgggcgtagaagtagtggttcggtcgtttaagttacgtgtacgagactagttattattacgttacttccttactacgtagtttcggaccgtacgggtaacgaacgtacgtacggacgtacgtacgacgtaacgaacgttcggtaggtctcgacctactacgttcg

SEQ ID NO: 338418 - DNA, 629 bp, Homo sapiens
  misc_feature: GZ8MTXP02HHJ25.38.20.B09.1.454.CMB.2.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagtcgatcacgtcacgaccggtgctcgatttagtgtagtgtgaagggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccgagtgtttanacaactcaagaataagagtcttagcttggaccagcaagaaaccacgacagcctcctaaagctgctcgtttaacngggcccttcgtacccgggaatcccggggtcctagaacgtctcagtggcggcggtctcgggacacgtagttcactcgtacacactcagcaacgccctggaccgggctagaaagtcgtggttacggtacggttttaaattaccgttaggttaccaagacccgtaaggttaactttagttacgtttaaccgttccttaacgtacgttaacgggtttttcggacccggttaaacgggggaacccctaaaggtccgttagggaagtacgcgtaccgaaacggtaaacctggttaacgggcttacggaccaccgtaaacttcg

SEQ ID NO: 338419 - DNA, 532 bp, Homo sapiens
  misc_feature: GZ8MTXP01C5XZ6.4.28.C06.1.454.CMB.2.raw
  modified_base (268)..(268): a, c, t, g, unknown or other
  misc_feature (268)..(268): n is a, c, g, or t
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (522)..(523): a, c, t, g, unknown or other
  misc_feature (522)..(523): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactgtctacattgggtccgccaggctccagggaagggctggtctgggtctctcgtattgatagtgatggcagtaccagaggatatgcggacgccgtgaggggccgattcaccatcttcagagacaacgccaaggcacgctgtanctggaaatgagcagtctgagagccgaggacacggctgtgtattactgtgacaagagataacggacttggtacgcctttagactaacgtcggggcccggggtacctgggtccaccggtctccgtcggcctccacaacgggcccagtccggtcctccccgtggcnccctagcctcaaggtcncaccctcgagcgcacngcgtcccngggctgacctggtcaaggctacttcccgtaangttcgcttcgngngcggnngacngcgtn

SEQ ID NO: 338420 - DNA, 546 bp, Homo sapiens
  misc_feature: GZ8MTXP01EN2UA.4.28.C06.1.454.CMB.2.raw
  modified_base (388)..(388): a, c, t, g, unknown or other
  misc_feature (388)..(388): n is a, c, g, or t
  modified_base (456)..(456): a, c, t, g, unknown or other
  misc_feature (456)..(456): n is a, c, g, or t
  modified_base (466)..(466): a, c, t, g, unknown or other
  misc_feature (466)..(466): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaggtgtcagtgtgaggtgctcctggtggaggtccgggggagcctagttcagcctgggacgtccctaagactctcctgtgcagcctctggattcacttcagtagttactggctacagttcgggtccgccaggctccgaggggaagggctggtctgggtctcgtcgtattgatagtgatggcagtacccagagatatgacggacgcgtgacgggcatcacatctnagagacaacgccaaggacacgctgatcgtaggaaatgaggcagttcagagacgccgaggtacacggtntagtgtaatntgttgacgaagaagtaagttaacggttcgttcggtaacgccctttgacgtacggttcgggggccccgggttaacgtcggg

SEQ ID NO: 338421 - DNA, 542 bp, Homo sapiens
  misc_feature: GZ8MTXP01BVNQL.4.28.C06.1.454.CMB.2.raw
  modified_base (270)..(270): a, c, t, g, unknown or other
  misc_feature (270)..(270): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
  modified_base (542)..(542): a, c, t, g, unknown or other
  misc_feature (542)..(542): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgagggccgattcaccatcttcagagacaacgccaaaggacacgctgtanctggaaatgagcagtctgagagccgaggacacggctgtgtattactgtgcaaagagataacggaccttgggtacgccctttgactaacgtcgggggcccgggaccctgggtcacccggtctccctcggccctccaccaagggccccatccggtcttccccctgggccgccctgcctccgaggcgcaccgtccgagacgcacgagccggccctggggctgcctgggtcaaggctacttcccgangttgcttctgacgcgggcnggcaaggcgn

SEQ ID NO: 338422 - DNA, 583 bp, Homo sapiens
  misc_feature: GZ8MTXP01C0JIT.4.28.C06.1.454.CMB.2.raw
  modified_base (271)..(271): a, c, t, g, unknown or other
  misc_feature (271)..(271): n is a, c, g, or t
  modified_base (448)..(448): a, c, t, g, unknown or other
  misc_feature (448)..(448): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccaggggaaggggctggtctgggtctctcgtattgatagtgatggcagtaccagaggatatgcggacgccgtgaggggccgattcaccatcttcagagacaacgccaaggacacgctgtanctggaaatgagcagtctgagagccgagacacggctgtgtatactgtgacaagagataacggaccttggtactcctttagacgtaacgtcgggggccccgggtaccctgggtccaccgtctcccgtccggccctccgaaccgaacgggccccagttccggtcccttcccccgtggccnccctgcctcccaggcgcaccctccgagacgcacgacggccggccccgtggggcctgcccgtgggtccaaacggttacttaacccttcccgtacacggttgccttcgtggaggccgggctgggaccaagggcgaac

SEQ ID NO: 338423 - DNA, 573 bp, Homo sapiens
  misc_feature: GZ8MTXP01A80W4.4.28.C06.1.454.CMB.2.raw
  modified_base (271)..(271): a, c, t, g, unknown or other
  misc_feature (271)..(271): n is a, c, g, or t
  modified_base (350)..(350): a, c, t, g, unknown or other
  misc_feature (350)..(350): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (506)..(506): a, c, t, g, unknown or other
  misc_feature (506)..(506): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
  modified_base (573)..(573): a, c, t, g, unknown or other
  misc_feature (573)..(573): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactgtctacattgggtccgccaggctccgagggaaggggctggtctgggtctctcgtattgatagtgatggcagtaccagaggatatgcggacgccgtgaggggccgattcaccatcttcagagacaacgccaaaggcacgctgtanctggaaatgaagcagtctgagagccgaggacacggctgtgtattacgtgtgacaaagagagtaacggacctttgggacncccgtttagaccttaacggcgggggtccccggggaccctgggtccacccggtctcccncgggccctccaaccgaacgggcccagtccggtcccttcccccgnggccncccgtagcctccgaggcnccgaccgtacgagacgcacgcgccggtccgnggctcgccgtgaacgaagttcctacttccgatgttcgcttcgngcggcggcncggacgaacggcgtn

SEQ ID NO: 338424 - DNA, 554 bp, Homo sapiens
  misc_feature: GZ8MTXP01BWQN1.4.28.C06.1.454.CMB.2.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (432)..(432): a, c, t, g, unknown or other
  misc_feature (432)..(432): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtanctaggaaatgagcagtcngagagccgaggacacggctgtgtattactgtgacaaagagataacggaccttggtacgccctttgactaacgtcgggggcccgggacctgggccaccgtctccgtcgccctccacgacgggcccagtccgtctccccctggccnccctgcctcgaggacgcaccgtcgagcgcacgcgcggccctggggctgcccgtggtaaccaaggttcctaccttcccaacgtgttcgcttcgtgacggccggggctgggacaacgggcgaac

SEQ ID NO: 338425 - DNA, 553 bp, Homo sapiens
  misc_feature: GZ8MTXP01DYLNG.4.28.C06.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (468)..(468): a, c, t, g, unknown or other
  misc_feature (468)..(468): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagtcttgggtttttccttgttgacttaattttaaaaggtgtccagtgtgaggtgctctggtggaggtccggggagcctagttcagcgtgggactcctaagctctcctgtgcagcctntggattcaccttcagttagttactggctacagttgggtcccnccaaggcctaccgaggggaaggggctggtctgggtctcgtcgtattgatagtgatggacagtacccagaggatatgcggacgcgtgacggggcatcacntctnaganacaacgcaaggacagctgtanctaggaaatgaagcagtcagagacgccgaggacacggtctagtntataactgttgacaagtaagagttaacgttcttagggtaaccctcgtttcgacgtacggttcgggggccccggttaaccgtccgg

SEQ ID NO: 338426 - DNA, 605 bp, Homo sapiens
  misc_feature: GZ8MTXP01EPT8N.4.28.C06.1.454.CMB.2.raw
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccattcaccatcttcagagacaacgccaaaggaccacgctgtanctaggaaatgaagcagtcngagagccgaggacacggctgtgtattactgtgacaaagagaataacggacttggtactcccttgacctaacggtcggggcccgggacctgggtccaccgtcctccgtcggccctccgaccgacgggcccagtccggttcccttcccccgnggccncccgtgccctcgaggcgccgacccgtcggagacgccacgcggccggcccgtggggcctcggccgtggaaccgaaacggttacccttacttaccccgacgtaacggttcgttccttcgtcgggacggtccggggtcgtcggggaccgtaaagggccgtaag

SEQ ID NO: 338427 - DNA, 578 bp, Homo sapiens
  misc_feature: GZ8MTXP01BFD7X.4.28.C06.1.454.CMB.2.raw
  modified_base (292)..(292): a, c, t, g, unknown or other
  misc_feature (292)..(292): n is a, c, g, or t
  modified_base (452)..(452): a, c, t, g, unknown or other
  misc_feature (452)..(452): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccggggagcctagttcagcctgggactccctaagactctcctgtgcagcctctggattcaccttcagttagttactggctacagttcgggtccnccgaggctccgaggggaagggctggtctgggtctctcgtatgatagtgatggcagtacccagaggatagtgacggacgccggtggacggggcctattcaccatctcagagacaacgccaaggacacgctagtatcgtaggaaatggagcagtctaggagngccgaggaccaggtctgtgtattaacgtgttagacgaaagagtaacgttaacgggctttacgggttaacctcccgtttaaggaccgttacgggttaccggggggtccccgggttaacccgttcggg

SEQ ID NO: 338428 - DNA, 581 bp, Homo sapiens
  misc_feature: GZ8MTXP01EMTZ1.4.28.C06.1.454.CMB.2.raw
  modified_base (271)..(271): a, c, t, g, unknown or other
  misc_feature (271)..(271): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaaggacacgctgtanctaggaaatgagcagtctgagagccgaggacacggctgtgtattactgtgacaaagagaataacggaccttgggtacgtccctttagacctaacgtcgggggccccgggacctgggtccaccgtctccgtcggcctccaccgaacggcccagtccggtccttcccccgnggccnccctgcctccgaggcgccacccgtccgagacgcacgcgccggccccgtgggcctacggccttgggtaaccaacggttacctaccttccccgtaagacgttcgcttcgtgacggccgggctgggaccaagggcaacg

SEQ ID NO: 338429 - DNA, 532 bp, Homo sapiens
  misc_feature: GZ8MTXP01BPVR5.4.28.C06.1.454.CMB.2.raw
  modified_base (271)..(271): a, c, t, g, unknown or other
  misc_feature (271)..(271): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaaggacacgctgtanctggaaatgagcagtctgagagccgaggacacggctgtgtattactgtgcaagagataaacggcttggtacgccctttgactaacgtcggggcccggggaccctgggtccaccgtctccgtcggccctccaccaagggcccatccggtcttccccctggccgccctgcctccagcgcacctcgagacgcacacggcgccctggcctgcctggtcaacggctacttccgacngttcgcttcgtgngcggctggacaaggcgc

SEQ ID NO: 338430 - DNA, 582 bp, Homo sapiens
  misc_feature: GZ8MTXP01AE9PW.4.28.C06.1.454.CMB.2.raw
  modified_base (252)..(252): a, c, t, g, unknown or other
  misc_feature (252)..(252): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (480)..(480): a, c, t, g, unknown or other
  misc_feature (480)..(480): n is a, c, g, or t
  modified_base (496)..(496): a, c, t, g, unknown or other
  misc_feature (496)..(496): n is a, c, g, or t
tcagagcactgtagcacgaccggtgctcgatttagagctcacgtattgggtttggggccccagccctgggattcccagctgtttctgcttgctgatcaggactgcacacagagaactcaccatggaatttgggctgagcttgggttttccttgttgcttattttaaaaggtgtccagtgtgaggtgctccgtggtggaggtccggggagcctagttcagcctgggacgtcctaagctctcctgtgcagcctntggacttcaccttcagttagttactggctacgagttcgggccgccaggctaccggagggagggctggtcgtggtctcgtacgtatgattaggtnagtggcagtacccaggagatagnggaacggcgcggtggacggggtactattccacatctacgagacgaacacgacgaagacacgtctagtatacgtaggaatcgagtcgagtcgagagacgcggagacgcggtnttacgtgtattaacgngttgacgaacggagtaacgttacggttcgttacggtccgttccttggtacccggtacgggttccgggggccccggttccgttccgg

SEQ ID NO: 338431 - DNA, 769 bp, Homo sapiens
  misc_feature: GZ8MTXP01CXSS5.4.28.C06.1.454.CMB.2.raw
  modified_base (241)..(241): a, c, t, g, unknown or other
  misc_feature (241)..(241): n is a, c, g, or t
  modified_base (530)..(530): a, c, t, g, unknown or other
  misc_feature (530)..(530): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccgagggaaggggctggtctgggtctctcgtattgatagtgatggcagtaccagaggatagtgcggacgccgtggagggccatcacatctnagagacacgcaaggacacgctgtatcgtaggaatgagctagtctagagacgccgaggacgacggcgttgtagtattacgtgtgacgaagaagtacgttaacggtaccgtttacgggtaccgttcccgttttacggaacccgttaacccggggtccggggggtcccccgggggtaacccgtttcggggtacccctaccccggtcccgttcccggtccgggtacccccttacccgaaaccgggtaaaccggggtccccctagtttcccccgggttcccctttccccccggngggcccccgtcccgttacgcccgtacccggaggacccgaccgtacccgtccggaagaccgaccgaaccggcggtcccggggtaccccgttgggggacccttcgggtaccccggttagggaaacccgtaaaacccggggttccctttaaccccgttccccgtaaagtcgggtttccgccgtttcgggaaggggacccgggtcccgggggtaccgtcggggaccgtaacggggcccgtaag

SEQ ID NO: 338432 - DNA, 565 bp, Homo sapiens
  misc_feature: GZ8MTXP02JHZ3M.4.28.C06.1.454.CMB.2.raw
  modified_base (278)..(278): a, c, t, g, unknown or other
  misc_feature (278)..(278): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactgtctacattgggtccgccaggctccagggagggctggtctgggtctctcgtattgatagtgatggcagtaccagaggatatgcggacgccgtgagggccgattcaccatcttcagagacaacgccaaggacacgctgtatctggaaatgancagtctgagagccgaggcacggctgtgtattacgtgtgcaaagagactaaacggcctttggaccgccctttagactacgtggggcccggggaccctgggtccaccgtctcctcggccctaccaccaaggccccagtccggtccttccccccgnggcccncctgacctccgaggcnccacccgtcgagacgcacgcggccggtccgnggctcggcctaggtaccgaacggtccttaccgtcccgtacgacgtcgcctcgcggacggcggcggtcggacgacggacgcg

SEQ ID NO: 338433 - DNA, 540 bp, Homo sapiens
  misc_feature: GZ8MTXP02GCDUY.4.28.C06.1.454.CMB.2.raw
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattggtccgccaggctccagggaaggggctggtctgggtctctcgtattgatagtgatggcagtacccagagatatgcggagccgtgaggggccgattcaccatcttcagagacaacgccaaaggacacgctgtatctaggaaatgagcagtctaggagacgccgaggacacggctgtgtattactgtagcaaagagagttaaacggacttaggaaccgtccctttaggactacgtcgggggaccccgggacctcggg

SEQ ID NO: 338434 - DNA, 545 bp, Homo sapiens
  misc_feature: GZ8MTXP02JCA52.4.28.C06.1.454.CMB.2.raw
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
  modified_base (522)..(522): a, c, t, g, unknown or other
  misc_feature (522)..(522): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactgtctacattgggtccgccaggctccgagggagggctggtctgggtctctcgtattgatagtgatggcagtaccagaggatagtggcgggacgccggtggacggggccgattcaccatcttcaganacaacgccaaggccacgctgatctggaaatgagcagtcngagagccgaggaccacggctgtgtattacgngtgacaaagagagtaacggcttggacncctttagactacgtggggccccggggactgggtcaccgtcnccgtcggccctccacaggcccagtcccggtctcccccgtggcccgccctagcctaccagggaccnccaccgtcgagacgcacgcggccgccgtggcncgcgtaggacacgtactacgtccagcgtcgctcgnggcggcggtcaggacgaggtcag

SEQ ID NO: 338435 - DNA, 593 bp, Homo sapiens
  misc_feature: GZ8MTXP02H0ECW.4.28.C06.1.454.CMB.2.raw
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctaggaaatgagcagtctgagagccgaggacacggctgtgtattactgtgcaagagataacggacttggtaccgtccttgactacgtcggggcccggggacctggtccaccgtctcccgtcggccctccaccgaacgggccccagtcccggtccctttcccccgtggcccncccctgcctccgaggacnccacccgtcgagacgccaacgcggccggccctggggccctggccccgttagggtaccaaaacgggtaccttaacccgttcccctaacgtacggtcgtcctccgtggacggtcgggctggggaccaagggcgacg

SEQ ID NO: 338436 - DNA, 549 bp, Homo sapiens
  misc_feature: GZ8MTXP02F6NTL.4.28.C06.1.454.CMB.2.raw
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaggtgtccagtgtgaggtgctctggtggagtccggggaggcctagttcagcctgggacgtccctaagactctcctgtgcagcctctggattcaccttcagtagttactggctacattgggtccgccaggctccgaggggaaggggctgggtctgggtctctcgtattgatagtgatggcagtaccccagaggatatgcggacgccgtgaggggccgattccgacatctcagagacaacgccaaggacacgctgtatcgtaggaaaatgaagacagtctaggagagccgaaggacacgggctggtgtattactgtagacaaagagagtaaacggcttaggtaaccgtcccgtttagacttacggcgggggcccgggaccctcggg

SEQ ID NO: 338437 - DNA, 559 bp, Homo sapiens
  misc_feature: GZ8MTXP02IBJGL.4.28.C06.1.454.CMB.2.raw
  modified_base (396)..(396): a, c, t, g, unknown or other
  misc_feature (396)..(396): n is a, c, g, or t
  modified_base (442)..(442): a, c, t, g, unknown or other
  misc_feature (442)..(442): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccgaggggaagggctgggtctggggtctctcgtattgatagtgatggcagtacccagaggatatgcggacgccggtgagggggccgattcacatctnagagacaacgccaaaggacacgctgatcgtaggaaatgagcagtcnggagagccgaggacacggctgtagtacttacgtgtgacaaaggagtacgtaaacgggtctttagggaacccgtcccgtttaggacgttacggtcgggggaccccggggtacctcggg

SEQ ID NO: 338438 - DNA, 584 bp, Homo sapiens
  misc_feature: GZ8MTXP02JHWLX.4.28.C06.1.454.CMB.2.raw
  modified_base (289)..(289): a, c, t, g, unknown or other
  misc_feature (289)..(289): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaggtgtccagtgtgaggtgctctggtggagtccggggagcctagtcagcctgggactccctaagactctcctgtgcagcctctggattccaccttcagtagttactggctacagttcgggtccnccaggcctccgaggggaagggctggtctgggtctcgtcgtatgatagtgatggcagtacccagagatangcggacgccggtgaggggccatcgactatctcagagacaacgcaagacacgctgtancgtagaaatgaagctagtcgtagaaggacggacccgaaggaacgtacgggcttaggttagtaagtttaaccgtggtagaacgaaaggtaaggtaacgtaaaccggtacgttaggtaacccgtccgtttagaccgttacggccgggggtaccccggggacccgttacggg

SEQ ID NO: 338439 - DNA, 588 bp, Homo sapiens
  misc_feature: GZ8MTXP02JLC6I.4.28.C06.1.454.CMB.2.raw
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
  modified_base (558)..(558): a, c, t, g, unknown or other
  misc_feature (558)..(558): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctaggaaatgagcagtctgagagccgaggacacggctgtgtattactgtgcaagagataacggaccttggtaccgtccctttgactacgtcggggccccggggtacctggtcacccgtctcccgtcggcctcccgacaacgggcccagtccggttccctcccccnggccgcccctagcctccgagggacnccaaccgtcccgagacgccaacgcggcccggcccgtggggcctggcccgtggtccgaaaaggtccttaaaccgttcccctaacgacgttcgccttcgngacggccgggtctagggccaacgggcgacg

SEQ ID NO: 338440 - DNA, 658 bp, Homo sapiens
  misc_feature: GZ8MTXP02FQCVB.4.28.C06.1.454.CMB.2.raw
  modified_base (294)..(294): a, c, t, g, unknown or other
  misc_feature (294)..(294): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaggtgtccagtgtgaggtgctctggtggaggtccgggggaggcctagttcagcctgggacgtccctaagactctcctgtgcagcctctggattcaccttcagtagttactggctacagttcgggtcccncaggcctccgaggggagggctggtctgggtctctcgtattgatgtgatggcagtacccaggaggatagtggcggacgccgggtggacgggggcctagttccactatcttcgagacgacaacgccgaaggaccacgctaggtactacgaggtaaaatggaacgacgagttactagggaaggaacgcccgggaaagggaccgtacggggtcgttagggttagttaaacgtttacgtagggtacgaacggtaaaagggtaacggtaaacggttaaaccggggtaccgtttaggggtaacccggttccccgttttaggacccggttaccggggttccggggggacccccggggtaccgtttcccgggg

SEQ ID NO: 338441 - DNA, 589 bp, Homo sapiens
  misc_feature: GZ8MTXP02HD055.4.28.C06.1.454.CMB.2.raw
  modified_base (560)..(560): a, c, t, g, unknown or other
  misc_feature (560)..(560): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaaggacacgctgtatctggaaatgagcagtctgagagccgaggacacggctgtgtattactgtgacaaagagaataacggaccttggtactccctttgactacgtcggggcccggggacctggtccaccgtcctcctcggccctcccaccgaacgggcccagtcccggtcccttcccccgtcggcccgtcccctcgcctccgaggacgccaacccgtccgagacgcacgacgccggcccctggggcctggcccgtggtaccgaaacgggtaccttacccgttccctaaacgcgtcgccttccgnggacggcgggcgtcggaccgacggcgacg

SEQ ID NO: 338442 - DNA, 606 bp, Homo sapiens
  misc_feature: GZ8MTXP02F2N9P.4.28.C06.1.454.CMB.2.raw
  modified_base (436)..(436): a, c, t, g, unknown or other
  misc_feature (436)..(436): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagcttgggttttccttgttgcttaattttaaaaggtgtccagtgtgaggtgctcctggtggaggtccgggggagcctagttcagcctgggactccctaagactctcctgtgcagcctctggacttcaccttcagttagttactggctacagttcgggtcccgcgaggcctccgaggggaacggggctggtcgtgggtctcgtcgtattgataggtgatggacagtacccagagatagtggcggacgccggtggacggggcctattccactatctacagacgacaacgcgaagacacgtntagtatacgtaggaaatgagcgtagtcgtaggagacgacggaaggacgacggtctggtagttattacgtaggtacgaacgtaaaggacgtaacgtaaacggtcgtttacgggtaaccgttcccgtttaggaccggttaccggtccgggggccccgggtaccgtttccggg

SEQ ID NO: 338443 - DNA, 726 bp, Homo sapiens
  misc_feature: GZ8MTXP02GD78E.4.28.C06.1.454.CMB.2.raw
tcagagcactgtagcacgaccggtgctcgatttagagctcacgtattggggtttgggggccccagccctgggattcccagctgtttctgcttgctgatcaggactgcacacagagaactcaccatggaatttgggctgagcttgggttttccttgttgcttaattttaaaaggtgtccagtgtgaggtgctcgtggtggaggtccgggggagcctagttcagccgtgggactcctaagctctcctgtgcagcctcgtggacttcaccttcagtagttactggactacgagttcgggtcccgccgaggcctaccggaagggggaacggggctgggtcgtggggtcctcgtcggtattgagttaggtgagtggactagtacccgaggagatagtcggccggacggccgggtgggacgggggtcctattccgaactattccgttacaaggaacgaaccgaaaccggacccgaaaaggggacccaccggtacgttacggttaacgtacgtaaggtaaaagtggaacgtaccgtaggttccgtagggaacgaccggaccgggaaggaccggtacgggtcgttagggttacgttaacgtttaccgtggttaacggaacgtaaaagggtaacggtaacggttaaaccgggtcgtttacgggtaacccgttacccggtttacggacccggttaccggggtcccggggggtacccccgggtacccgtttcccggg

SEQ ID NO: 338444 - DNA, 567 bp, Homo sapiens
  misc_feature: GZ8MTXP02JWWSK.4.28.C06.1.454.CMB.2.raw
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggagcctagttcagcctgggacgtccctaagactctcctgtgcagcctctggattcaccttcagtagttactggctacattgggtccgccaggctccgaggggaaggggctggtctggggtctctcgtattgatagtgatggcagtaccccagaggatatgcggacgccgtggagggggccattcgacctatcttcagacgacaacgccaaaggacacgctagtatcgtaggaaatgaaggcagtctgagagccggaggacacggctgtgtattactgtgctaaaggagtacgtaaacggtcgttacgggtaaccgttccgttacggaccgttacgggtccgggggaccccggtacgtcccggg

SEQ ID NO: 338445 - DNA, 587 bp, Homo sapiens
  misc_feature: GZ8MTXP02JIWLC.4.28.C06.1.454.CMB.2.raw
  modified_base (564)..(564): a, c, t, g, unknown or other
  misc_feature (564)..(564): n is a, c, g, or t
  modified_base (575)..(575): a, c, t, g, unknown or other
  misc_feature (575)..(575): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtggaggggccgattcaccatcttcagagacaacgccaaggacacgctgtatcgtaggaaatgagcagtctgagagccgaggacacggctgtgtattactgtgcaagagaataacggaccttggtaccgccctttaggactacgtcggggccccggggacccttggccacccgtctccgtccggccctcccgaaccgaacgggccccagtcccggttcccttccccccgtggccccgtccctgcctccgagggacgccacccgtcgagacgcaccgacggccggccctgggcctgtacccgtgggtaccaacggtaccttaccgttccacgtacgtcgcttacgngacggcggtcnggaccacgggca

SEQ ID NO: 338446 - DNA, 613 bp, Homo sapiens
  misc_feature: GZ8MTXP02IXL9P.4.28.C06.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagagcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctccgtggtggagtccgggggaggcctagttcagccgtgggacgtccctaagactctcctgtgcagcctntggattcacttcagtagttacnggctacagttggccncaggctccgagggaggctggtcgtggtctcgtcgtattgatagtgagtgctagtacccgagaggatagtggacggacgccgggtggacggggccgtactcaccgtatcttacgagtacgacaacggacaacgacacgctagtactcgtaaggaaatggaacacgtagtacagggaacgacggaccggaggaccgacggtgtagttagttaacttcgtggtgaacgaaaggaacgtaacgaaaccggttacgttacggtaaccgttacccgtttaggacccggttacgggtccgggggtacccgggtaacccgtttccgggg

SEQ ID NO: 338447 - DNA, 649 bp, Homo sapiens
  misc_feature: GZ8MTXP02JA5FJ.4.28.C06.1.454.CMB.2.raw
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
  modified_base (614)..(614): a, c, t, g, unknown or other
  misc_feature (614)..(614): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaagggctggtctgggtctctcgtattgatagtgatggcagtaccagaggatatgcggacgccgtggagggccattcaccatctcagagacaacgcaaggacacgctgtatcgtaggaaatgagcagtctagagacgccgagacacggctgtgtattacgtgtagacaagagtaagtaacggtacctttggtaccgtccctttagaccgttacggtccgggggcccccgggggtaccttcgggtcctacccgttcctacccgtccggccctacccgaaccgtaaccggccctacgtccggtcccttcccccgtggccctcccgngacccgtacgaggtaccnccacccgtcccggagacgaccgacgtaccgggcccggtcccgtggggtcccttcgggaaccgtcgggtacctaaaacgggtcccttaacccggtttccccacgtacgtcgccgttcncgggtacggcgggtcgacggacgaacggccgaacg

SEQ ID NO: 338448 - DNA, 730 bp, Homo sapiens
  misc_feature: GZ8MTXP02FJ3GC.4.28.C06.1.454.CMB.2.raw
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
tcagagcactgtagcacgaccggtgctcgatttagagctcacgtattgggtttggggggcccccagccctgggattcccagctgtttctgcttgctgatcaggactgcacacagagaactcaccatggaatttgggctgagcttgggttttccttgttgcttaattttaaaaggtgtccagtgtgaggtgctccgtggtggaggtccggggaggcctagttcagccgtgggacctcctaagctctctgtgcagcctntggacttcaccttcagtagttactggctanagttcgggccncgacggctcggagggaagggcgtggtcgtgggtctcgtacgtatgatagtgagnggacacgtacccagagatagtcggcggacgtccggtagggacggggtaccgtacttccaactcttacttacgaacggaaacgaaccgaaacggaccgaaaccgggacaccggtcgttacggttacgtaccgttaacgggaaacgtggaggtaccgtaggttaccgtaaggaacggaaccgggaccggaagggaacccgtacgggtaaccgttgggttagttaaccgtttaaacgtagggtaccggtaaacgtaaaggtaacggtaaacggttaaaaccgggttaccgtttaacgggggtaacccgtttacccggtttaaccggtacccggttaccggggtacccggggggtacccccgggttacccggttaacccggg

SEQ ID NO: 338449 - DNA, 630 bp, Homo sapiens
  misc_feature: GZ8MTXP02HLSVB.4.28.C06.1.454.CMB.2.raw
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (458)..(458): a, c, t, g, unknown or other
  misc_feature (458)..(458): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgcgtgaggggccattcaccatcttcagagacaacgccaaaggacacgctgtatctaggaatgancagtcngagagccgagacacggntgtgtattactggtgacaaagagataaccgggacttggtaacctccctttagacgtaccgtgggggccccggggaacccttgggtacctacccgtcgtcccgtcgggccctacccgaccgaaacggggccctaacgtccggttcccttcccccgnggtcccgtcccctcgcctcccgaggtcgaccgaccccgtaccgagacggacaccgacggtcccggcccgtggggcctcggccgtcgggtaccaaaagggtccctaaccgtttaccctacgacgtcggtccgtcttcggaacggccggacgtgggacccgaaagggccgtacg

SEQ ID NO: 338450 - DNA, 864 bp, Homo sapiens
  misc_feature: GZ8MTXP02J1FQA.4.28.C06.1.454.CMB.2.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagagcactgtagcacgaccggtgctcgatttagagctcacgtattgggtttgggaggcctagttcagcctgggacgtccctaagactctcctgtgcagcctctggattcaccttcagtagttactggctacattgggtccgccaggctccgagggaaggggctggtctgggtctctcgtattgatagtgatggcagtaccagaggatatggcggacgccgtggaggggccattcaccatcttcagagacaacgcccaaggaccacgactgtatcgtaggaatgancagtntgagacgccgaaggacacggctggtagtacttactgtagacgaaaggtacgaacgttaaaccgggtaccgttacgggttaacccgtcccgtttttacggaaccgtttacggggtcccgggggggtaccccccgggggtacccgtttaacggggtaccccgtacccggttaacccgtttcccccgggtttaaacccgggcccccgtttaaacccccgaaaacccgggttaaacccggggggtaccccccctaagggttttacccccggggttccccttttaccccccccgggggtcgggtacccccgtccccggttacggtccccgtaacccgggtaacggtacccgtacccgtaaccccggtaccgggaacgacccgggtaacccaccggtaacccgggttccccggggtacccgtttcggggaccccgttccgggtacccggttaacggtaacccggttaaaaccggttacccttaaccccggtttacccgtaacgtaccggttaccgtcccgttaccgggtaacgggtacgggtcccgggtacgtaccgggaaacgtaccgggtactacg

SEQ ID NO: 338451 - DNA, 558 bp, Homo sapiens
  misc_feature: GZ8MTXP01B2XEJ.45.80.H03.1.454.CMB.2.raw
  modified_base (163)..(163): a, c, t, g, unknown or other
  misc_feature (163)..(163): n is a, c, g, or t
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
  modified_base (508)..(508): a, c, t, g, unknown or other
  misc_feature (508)..(508): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggcttttccncgttgctctttgagaggtgtccagtgtcaggtgaagttggtggagtcgtgggggagcgtggtccagcctgggagtccctgagactctctgtgaagtcagtggattcaacttcagtaactatgaccatacagttgggtccncaggctccgaggcaagggggctggagtggctgtctagttattacgaaaaaaggtataacatatattaatagaagctacataagggcatcaccatcncagacgacataccaaagaacncggtanatcagacagggatggacncgacgcgagacgtacagaaccgacgcggtcttaagtacttaagttagttcgtacgacgttaagngttacgtaaggcgggaaccgggaacgggggagacggtaagggttcggtcg

SEQ ID NO: 338452 - DNA, 537 bp, Homo sapiens
  misc_feature: GZ8MTXP01DDWN0.45.80.H03.1.454.CMB.2.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (466)..(466): a, c, t, g, unknown or other
  misc_feature (466)..(466): n is a, c, g, or t
  modified_base (494)..(494): a, c, t, g, unknown or other
  misc_feature (494)..(494): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagactctcctgtgaagtcagtggattcaacttcagtaactatgccatacattgggccnccaggctcaggcaaggggctggagtggctgtcagttattacaaaaaggatacatatattaangaagactactaagttaagggcctattcacctatctccagagacacttacgaaagaagcggtatatctagcaagggatgaagcagccgtgacggcctgacgacncggctgtcttagttattgtcgccaaggnatgtcggggcccggtaaggggggagactaaggggttcgggcgg

SEQ ID NO: 338453 - DNA, 531 bp, Homo sapiens
  misc_feature: GZ8MTXP01A6WXI.45.80.H03.1.454.CMB.2.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtgcgtttccacggttgctacttttgagaggtgtccagtgtcaggtgaagttggtggagtcgtgggggagcgtggtccagcctgggagtccctgagactctcctgtgaagtcagtggattcaacttcagtaactatgccatacattgggtccncaggctccaggcaaggggctggagtggctgtcagttattacaaaaaggaatanatatattaatgaanactacattagggccattcacatcncaganacacttacaagtaagcgtatanctgnagangagacacgcgngacgcgacgacgacgacgcgtgtcttattagttgtacgtacgagagagtaagtcggaacgggacggggacgggacggtaaggttggtcgg

SEQ ID NO: 338454 - DNA, 525 bp, Homo sapiens
  misc_feature: GZ8MTXP01A54YK.45.80.H03.1.454.CMB.2.raw
  modified_base (277)..(277): a, c, t, g, unknown or other
  misc_feature (277)..(277): n is a, c, g, or t
  modified_base (485)..(485): a, c, t, g, unknown or other
  misc_feature (485)..(485): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctntattgataatatatctggactctaagaggcccctcgagggatccctgagcgattctctggctcccagcgcgagggacaaactgtcacattgaccatcattgatccagcctgaggacgaggctagactattactgtacagtcgagtagacgccaccactctcacgtcgtcgtcggcggacggaaccaagctggacccgtcgtcggttcncgcccgaagcctcgccccctggacctccgttccgttcccg

SEQ ID NO: 338455 - DNA, 533 bp, Homo sapiens
  misc_feature: GZ8MTXP01C087F.45.80.H03.1.454.CMB.2.raw
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (499)..(499): a, c, t, g, unknown or other
  misc_feature (499)..(499): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagccgtggggaggtccctgagactctcctgtgaagtcagtggattcaaattcagtaactatgccatacattgggtcccnccaggcctccgagggcaaagggggctggagtggctgtcagttattacgaaaaaaggataanatatataatagaagactcaattaacgggcatcacatcacaganacactacaagaaagcggtatatctagcaaggactgaagcaagcctgacggcctgaaccgacacgggctgtcttattattgtcgacagnatgtcggccgaggggggagacctaagggttggcg

SEQ ID NO: 338456 - DNA, 557 bp, Homo sapiens
  misc_feature: GZ8MTXP01AEP12.45.80.H03.1.454.CMB.2.raw
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (480)..(480): a, c, t, g, unknown or other
  misc_feature (480)..(480): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtctgggggagcgtggtccagcctgggagtccctgagctctcctgtgaagtcagtggattcaacttcagtaactatgccatacagttcgggtccnccaggctccgaggcgaagggggctggagtggctgtactagttaattacgaaaaaaggaataanatatattaaangaanctacaattacgggctattcactatctaccagacgaccacttaccaaagaaagcggtatatcagcaggatgagcagcctggacgcctgacgacaccgggtntgtacttattagttcgtacgccgaagttagttagtaaggtcgggaaccgggaggggggacggacgtgggttcgggcg

SEQ ID NO: 338457 - DNA, 579 bp, Homo sapiens
  misc_feature: GZ8MTXP01DIURN.45.80.H03.1.454.CMB.2.raw
  modified_base (302)..(302): a, c, t, g, unknown or other
  misc_feature (302)..(302): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (517)..(517): a, c, t, g, unknown or other
  misc_feature (517)..(517): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagactctcctgtgaagtcagtggattcaacttcagtaactatgccatacagttgggccnccaggctccgaggcgaaggggctggagtggctgtcaagttattaacgaaaaaaggtaataacattaatattaaatagaagtactaccaaagttaacggggcctattcaccatctaccagacactactacaaagaagcgtatactntagcaggatgancagcctgacgcctgaccgacgcggtctgtacttagtttacttggtacgccgttaaggngttaagtaaggtcggggaacccgggaacgggggggaggttacgtaaggggttcgggtccggg

SEQ ID NO: 338458 - DNA, 617 bp, Homo sapiens
  misc_feature: GZ8MTXP01ATB7G.45.80.H03.1.454.CMB.2.raw
  modified_base (304)..(304): a, c, t, g, unknown or other
  misc_feature (304)..(304): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggtccagcctgggagtccctgagactctcctgtgaagtcagtggattcaacttcagtaactatgccatacagttcggtccnccaggcctccgaggcaagggggctggagtggctgtactagttattaacgaaaaaaggaataacataatattaaatagaagtactaccaagttaacgggcctattacaacctatctaccaagacgactacttaccgaaagtaaacgtcggtataactcgtagactaaggatggacgaccaagtcccgtaggacggtccgtacggaaccgtacgacggcgttaagtacttaatttacgttggacgacccgttaaggagttaacgttaaggccgggaacccgggaaggggggaggaccgtaagggttcggcccggg

SEQ ID NO: 338459 - DNA, 523 bp, Homo sapiens
  misc_feature: GZ8MTXP01A4W2P.45.80.H03.1.454.CMB.2.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
  modified_base (493)..(493): a, c, t, g, unknown or other
  misc_feature (493)..(493): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctcctcactcaggacacagggtcctgggcccagtctgccctgactcagcctgcctccgtgtctgggtctcctggacagtcgatcaccatctcctgcactggaaccagcagtgatgttgggattataacctgtctctggtacaacngcacccaggcaaagcccccaaatcatgatttangaggcagtagcggcccttagggtttcaatcgcttctctcggctcaagtctggacaacncggcctccctgacaatctctgggcctccgaggctggaggacgaggctgattatactgctgctcatatgcaggttgtagttacgtttggtgttcggcgggagggaaccaagctgaccgtcgtaaggttcngcccaaggctcgcccctggctcttcgtccg

SEQ ID NO: 338460 - DNA, 589 bp, Homo sapiens
  misc_feature: GZ8MTXP01AR6OF.45.80.H03.1.454.CMB.2.raw
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctggggagtccctgagactctcctgtgaagtcagtggattcaacttcagtaactatgaccatacagttcgggtcccgccaggcctccgaggcgaagggggtctgggagtggctgtacagtttattacgaaaaaagggtaataacgataataattaatagaacgtactaccgtaaagtttaacggggcctaattaccgaacccatacctaccaagacgaaccacttaccgaaagaaacgtcgggtataactcgtagccaaggggatcggagccagcccgtggacggcctcggacgaccgcggctaagtcttagtattgcgacngagataanggtcccgagggggtagacaaggttcgcgg

SEQ ID NO: 338461 - DNA, 547 bp, Homo sapiens
  misc_feature: GZ8MTXP01EPZZB.45.80.H03.1.454.CMB.2.raw
  modified_base (278)..(278): a, c, t, g, unknown or other
  misc_feature (278)..(278): n is a, c, g, or t
  modified_base (475)..(475): a, c, t, g, unknown or other
  misc_feature (475)..(475): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaaatatggttactggtaccagcagaaggcggcaggcccctntattgaataatatatctggactcgtaagacggccctcgagggactccccgtgagtcgtatttcctctcggcctcccgagcgacgaagggaccaaaactgtcaactattcgacctatcgagtttacggacgtccaacgtcctagaggacgaaggctagacttattacgtgtacagtacgagtagaccaccacactacncacgtcgcgtcggcgagggaacaagcncgacgtcttgcgngcccgaagcncgcccctgttctcttcgtcccg

SEQ ID NO: 338462 - DNA, 674 bp, Homo sapiens
  misc_feature: GZ8MTXP01ES7G7.45.80.H03.1.454.CMB.2.raw
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgctcttttgagaggtgtccagtgtcaggtgaagttggtggagtcgtgggggagcgtggtccagccgtggggacgtccctgacgactctcctgtagaagtcagtggattcaacttcagtaactatgccatacagttcgggtcccgccaggcctccgaggcgaaggggctggagtggctgtcaagttaatttaacgaaaaaaggataanatatattaaanagaagactacaagttaacgggcctattacactactctaccagacaaccacgttaaaccaaggtaaacgccggttatactctagacaggaagtagagaccgacgtcccgtggaacgcccgtaggaacccgtaacggcgggtccttaacggttaactttagttaaagtttcggaccggttaaccgaacgggttaaggaaccgtttaaagggtcccgggggaaaccccgggggtaaacgggggggggaggggttaacccggggtaacgggggttaacccggggtaacccggg

SEQ ID NO: 338463 - DNA, 552 bp, Homo sapiens
  misc_feature: GZ8MTXP01D563F.45.80.H03.1.454.CMB.2.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (367)..(368): a, c, t, g, unknown or other
  misc_feature (367)..(368): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtctgggggagcgtggtccagccgtgggagtccctgagctctcctgtgaagtcagtggattcaattcaagtaactatgaccatacagttggcccnccaggcctcgaggcgaaggggctggagtggctgtcagttatacaaaaaggataanatatataannaagctcaattagctatcacatcacananctaacttacgaaagaaagcgtattancgtanacaggatgacgcgacgtcgnggaccgcgacgacgacgtcgtctgttattattcgttgacgtacgaaggttnttacggtaagggtcgggaaccggggagggggacgttacggtcgggttcggtcgg

SEQ ID NO: 338464 - DNA, 636 bp, Homo sapiens
  misc_feature: GZ8MTXP01DGJQ2.45.80.H03.1.454.CMB.2.raw
  modified_base (307)..(307): a, c, t, g, unknown or other
  misc_feature (307)..(307): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaaggttggtggagtcgtgggggagcgtggtccagcctggggagtccctgagactctcctgtgaagtcagtggattcaacttcagtaactatgaccatacattgggtcccnccaggctcgaggcgaagggggctggagtggctgtactagttattaacgaaaaaaagggaataaacgataatattaaatagtaagactaccgaaagtttaaacggggcccgtaattacaacccattcctaccgaagacgaactaacgttaaccaaaggaaacgtcggtagttaactcgtacgacaaggtacgttaggaacgtacacgcccgtaggacgggccctaggaaccgacgaacgggtccttaaggttcttatttagttcgtcgaccaggttagagttaaggtcgggccggtaacggggggaggttaccgtgggttcgggtcccgg

SEQ ID NO: 338465 - DNA, 569 bp, Homo sapiens
  misc_feature: GZ8MTXP01AETSL.45.80.H03.1.454.CMB.2.raw
  modified_base (162)..(162): a, c, t, g, unknown or other
  misc_feature (162)..(162): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (481)..(481): a, c, t, g, unknown or other
  misc_feature (481)..(481): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttccncgttgctcttttgagaggtgtccagtgtcaggtgaagttggtggagtcgtgggggagcgtggtccagcctggggagtccctgagactctcctgtgaagtcagtggattcaacttcagtaactatgccatacagttgggtcccncaggcctccgaggcgaagggggctggagtggctgtcagttattacgaaaaaggatanatatataangaanactcataggcatcacntcacagacacactaccaagtaagcggtatatctagacagggataggacgtacaggccctaggacggtccctaggaccgacgtaccgggtnttcgtacttagttacgttggtacgacgagttagttacgtaacgggcgggaaccgggacggggggacggttacgtcgggttcgggtcgg

SEQ ID NO: 338466 - DNA, 562 bp, Homo sapiens
  misc_feature: GZ8MTXP01EYVGV.45.80.H03.1.454.CMB.2.raw
  modified_base (277)..(277): a, c, t, g, unknown or other
  misc_feature (277)..(277): n is a, c, g, or t
  modified_base (521)..(521): a, c, t, g, unknown or other
  misc_feature (521)..(521): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctntattgaataatatatctggactctaagacggccctcgagggactccccgtgacgcgtattctcgtcggcctccccaggcgacgaggggacaaaactgtcactacttcgaccctatctagttgggacgtccacggccgtaggacggacggagggcttaggacttattactgtacagtcgagtacgaccgccaccactactcacgtcgtcgtcggcggacggaacaagctcgaccgtcgtggttcncgccgaaggctcccgccccgtcggcctccgttccgttcccg

SEQ ID NO: 338467 - DNA, 617 bp, Homo sapiens
  misc_feature: GZ8MTXP01BX0RR.45.80.H03.1.454.CMB.2.raw
  modified_base (309)..(309): a, c, t, g, unknown or other
  misc_feature (309)..(309): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (490)..(490): a, c, t, g, unknown or other
  misc_feature (490)..(490): n is a, c, g, or t
  modified_base (535)..(535): a, c, t, g, unknown or other
  misc_feature (535)..(535): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccaggcctgggagtccctgagactctcctgtgaagtcagtggattcaacttcagtaactatgaccaataccagttcgggtcccnccgaggcctccgaggccgaaagggggctggagtggctgtcagttattaacgaaaaaggataanatatattaaanacgaagtactaccaagttaacgggccgtaattacacctattccaccaaggacaacctattaacccgaaagtaaacggcgtagtaatccgtagactaggggtatgganacgagtccctggacggaccctggacccgacacgggtctgtacttntttacgttgtcggaccaaggcgttagttaacggtcggggaacccggaagggggggacgttacgaacggggttcgggtcccgg

SEQ ID NO: 338468 - DNA, 583 bp, Homo sapiens
  misc_feature: GZ8MTXP01BJSOH.45.80.H03.1.454.CMB.2.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (476)..(476): a, c, t, g, unknown or other
  misc_feature (476)..(476): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctgganatgctttgaccaaacacaaatatggttactggtaccagcaggaaggcggccacggcccctntattgaataatatatctaggactacgtaagcggcccctagaacgggactccccgtagacgcgtatttcctctggcctccccgaggcgacgaagggaccaaactcgtcactattcgaccctatcagttcggactccaggcctaggaggacgaaggctagactattactgtcagtcgagtagaccgtccaaccnctaactcgacggtcgtcggttcggcgggaggaaccaagcgtacgaccgtccgttggaccgcgaccccgaagtcccgtccgcccccgtggttacctccgttctccccg

SEQ ID NO: 338469 - DNA, 512 bp, Homo sapiens
  misc_feature: GZ8MTXP01AYGSR.45.80.H03.1.454.CMB.2.raw
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
tcagacgcgatcgacacgaccggtgctcgatttagctgtgcgtcgaagggaaagggggtgggtccaggaggcagaactctgggtgtctcaccatggcctgggtccctctacttctacccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatccctgagcgattctctggctccccagcgcaggggacaaaactgtcacattgaccatcattgagtcagctgaggacgaggctgactattactgtcagtcagtagacgccaaccactactcacgtcgcgttcggcggagggaaccaagctgaccgtcctggttcngcccaaggcccncgccctcgctcgttcgtcg

SEQ ID NO: 338470 - DNA, 635 bp, Homo sapiens
  misc_feature: GZ8MTXP01ALBDI.45.80.H03.1.454.CMB.2.raw
  modified_base (396)..(396): a, c, t, g, unknown or other
  misc_feature (396)..(396): n is a, c, g, or t
tcagacgcgatcgacacgaccggtgctcgatttagctgtgcgtcgaagggaaaggggtctgggagacgagcccagcactggaagtcgccggtgtttccactcgatgatcatcaccgaacacagaggacgcaccatggagtttgggctgagctggcttttcctcgttgctcttttgagaggtgtccagtgtcaggtgaagttggtggagtcgtgggggagcgtggtccagccgtgggacgtccctgagactctctgtgaagtcagtgattcaactcaagtaactatgacctatactagttgggtcccgccaggcctccgagggcaagggggctagggagtcggctgtactagtttaatttaaccgaaaaaaaggtaataacataagtaaatttaagngaaacgtactaccgtaagtttaaggggcctatttaccgaacctattccaccgaagacacctaacttaccgaaaagtaaacgcggttagtaactcgtagcaaagtagtcggaacacacggcccgtagaaccgggtccctagggaacccgtacgaccgggtcttcggttaccttaaagtttcgtggtacgcgttagagttaacgtagtcgggaccggaggggggagaaccgttgggtcggg

SEQ ID NO: 338471 - DNA, 664 bp, Homo sapiens
  misc_feature: GZ8MTXP01EGG5C.45.80.H03.1.454.CMB.2.raw
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggtccagccgtgggagtccctgagactctctgtgaagtcagtgattcaaacttcagtaactatgaccatacagttcgggtccnccaggctccgaggcgaagggctggagtggctgtctagttaattacgaaaaaaggaataaanataatattaaatagaacgtactaccaaagttaaacggggccctaaattccaaccctaatcctaccgaagacgaacctaactttaacccgaaaagaaacggtcgggtataaacttctagacaggtagtagacgacgacgaccgtacggacggaccgtacgtaaccgaaccgtaccgtacgttaacgttacgtttaatttagttacgtacgtaacgaacgttaacggttaaggtaacgggtacggggtaaccggggaacggggggtaacgggggttaacggtaacgggttcgggtccggg

SEQ ID NO: 338472 - DNA, 621 bp, Homo sapiens
  misc_feature: GZ8MTXP01CBCPV.45.80.H03.1.454.CMB.2.raw
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (501)..(501): a, c, t, g, unknown or other
  misc_feature (501)..(501): n is a, c, g, or t
  modified_base (574)..(574): a, c, t, g, unknown or other
  misc_feature (574)..(574): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggtccagccgtgggagtccctgagactctctgtgaagtcagtggattcaacttcagtaactntgccatacagttcgggtccnccgaggcctaccgaggacgaagggggctggagtggctgtactaagttaattaacgaaaaaaaggtataaacataatattaaatagaagtactaccgaagttaacgggactattcacctatcctaccgaagacgtaacctacgttaccaaaggtaaacgtcgggtataactcgtaggaccaaggggattagggaacnccgtaagcccgtagggacggtaccctggaaccgacgacggtcctaagtattagtttagttgtacgccttaagngacttgggacggcccggggtaagggggagacgtgggttcgggtccgg

SEQ ID NO: 338473 - DNA, 581 bp, Homo sapiens
  misc_feature: GZ8MTXP01A44ID.45.80.H03.1.454.CMB.2.raw
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggtcgttttcctacgttgctcttttggagaggtgtccagtgtcaggtgaagttggtggagtcgtgggggagcgtggtccagcctgggaggtccctgagactctcctgtgaatcagtggattcaacttcagtaactatgccaatacattgggtcccnccaggcctccgaggcaagggggctggagtggctgtctaagttattacgaaaaaaggataaacatatattaaanagaatactacgtaagtacggctatacactatcacgagactactacttaacgaaagaacgtcgtatatctagagaggtatagacgacgacgcgtcgacggtacgacgtacgacgacgtcgtcgtcgttagttacgttgtacgtacgacgttacgttagtaaggtacggcgggacggggacgggacggtcggttcggtcgg

SEQ ID NO: 338474 - DNA, 556 bp, Homo sapiens
  misc_feature: GZ8MTXP01A40MC.45.80.H03.1.454.CMB.2.raw
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagcgtggcttttcctcgttgctcttttgagaggtgtccagtgtcaggtgaagttggtggagtcgtgggggagcgtggtccagcctgggagtccctgagactctcctgtgaagtcagtggattcaacttcaagtaactatgccatacagttgggtcccncaggctccgaggcaaggggctggagtgctgtcagttattacaaaaaggataanatatattaatagaagtactacgaattaacgggccattacaccatcctaccagacgaacctacttaccgaaagtaaagcgtagtaattcagcaaggatagagcagcccgtagacgtccngaccgacacgggntaagtcttaattcgttgtcacgagttagnttaaggnggaaccggacgggggagaccgtggcggtcgg

SEQ ID NO: 338475 - DNA, 627 bp, Homo sapiens
  misc_feature: GZ8MTXP01BCWAH.45.80.H03.1.454.CMB.2.raw
  modified_base (301)..(301): a, c, t, g, unknown or other
  misc_feature (301)..(301): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagctctctgtgaagtcagtggattcaacttcagtaactatgccatacattcgggtccnccaggctccgaggccaagggggctggagtggctgtcagttattacgaaaaaaggtataacgatatataatagaagtactccgtaagttacgggacctattaccactattcctaccaagacgaacctacttaccgaaagtaaacgcggtagtatccgtagaccaggggtatggagccgtaagcccgtaggagggcccctgggaaccgaccgacggtcgttaaggttcccttaaagtttcgttggtacgtacccgaagggttacgttagtaacggtcgggggaaccccggaaggggggggtaggaccggtaagggttcggggcccggg

SEQ ID NO: 338476 - DNA, 596 bp, Homo sapiens
  misc_feature: GZ8MTXP01ANDN5.45.80.H03.1.454.CMB.2.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (494)..(494): a, c, t, g, unknown or other
  misc_feature (494)..(494): n is a, c, g, or t
  modified_base (549)..(549): a, c, t, g, unknown or other
  misc_feature (549)..(549): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtgcttttcctcgttgctcttttgagaggtgtccagtgtcaggtgaagttggtggagtcgtgggggagcggtggtccagccgtgggacgtccctgagactctcctgtgagtcagtggattcaacttnagtaactatgccaatacagttcgggtccncgaggcctacgaggcgaaggggctggagtggctgtctaagttattaaacgaaaaaaggtaataacgtaataatattaaaatagaacgtctacgtaagttacgggactattacacctatcctaccgagacgaactacgttaccgaaagtaaacgtccggtataacgtcgtacgacaggtaatcggaanccgagccgtgacgcgacgacgacgcggtcctgtaccttagtattcgtagacgagngacttggccgggaacgggacgggggaggaacgtgggttcggtccggg

SEQ ID NO: 338477 - DNA, 545 bp, Homo sapiens
  misc_feature: GZ8MTXP01B2Q2W.45.80.H03.1.454.CMB.2.raw
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (506)..(506): a, c, t, g, unknown or other
  misc_feature (506)..(506): n is a, c, g, or t
  modified_base (527)..(527): a, c, t, g, unknown or other
  misc_feature (527)..(527): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagccgtgggagtccctgagactctctgtgaagtcagtggattcaacttcagtaactatgccatacattcgggtccgccaggcctccgaggcaagggggctggagtgctgtcagttatttacaaaaaagggataacatatataangaagactcaattaagggcatcacatctcaganacattaccaaagaancgggtatanctgacaggatgaagcagccgtgacggcctaggacgacacgggctggtcttaaatttgttgtcgtcaagagttacgtaancggggaacccgtaaggggggngacctaagggttggtccg

SEQ ID NO: 338478 - DNA, 698 bp, Homo sapiens
  misc_feature: GZ8MTXP01AHZAD.45.80.H03.1.454.CMB.2.raw
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagcccaccctcggtgtcagtcgtccccaggacagacggccaggatcacctgctctggagatgtctttgaccaacacaatagtggttactggtaccagcgaaggaagggccggccacggccccctatattagattaatatatctggactacgtaacgacggccctgacgggactccccgtgacgcgtattcgtctcggcctcccgaggcgacgagggacaaacgtgtcactatacgacctatctagttggactccgaggtccgtagggaacgggtacggacgggtactacggtaactttagttaacgtcggttacgtaacggtacgtaacggttaaccgacccggtaccccaaacccgtaaccgttaccctacccgtaaccgggttcccgtcggggttaccccggggacggggaaccgggaaccgaacgttccgtaccggttaccccgttccggtcggttaccgacggttaccccaacggggtccctccccggtacccccgttccggttaccctaaccgtttcccgtttccccg

SEQ ID NO: 338479 - DNA, 716 bp, Homo sapiens
  misc_feature: GZ8MTXP01C3FOF.45.80.H03.1.454.CMB.2.raw
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcttggctttttcctcgttgcttcttttgagtaggtgtccagtgtcaggtgaagttggtgaagtcgtgggggagcgtggtcagctgggagtcctgagctctctgtgaagtcagtggattacaacttcagtaactatcgacctatacagtttcgggacccgcagggcctaccgaggaccgaagggggctaggtagtcggcttaggtactaaagtttaacttaaacgaaaaaaaagggtaacttaacgtaatttaattaagttaaaataacggaacgttaaccttaaacccggtaaagttttaaacggggaccctaatttaccaaacccgtatttaccctaccgaaggtaaaccgtaaccttaaaccgttaacccggaaaaggtaaacgtcgggttaatactccgtagaacgaaggtacgtaggacacgaacgtccgtaggaccgggctaggaccgtacgacggtcttaacggttacttagtttcgttacggacgaaccgaaggttagacgttaacgggacgggaacccgggggtaagggggagttaccgaaggggtttcggaaccggg

SEQ ID NO: 338480 - DNA, 654 bp, Homo sapiens
  misc_feature: GZ8MTXP01A9HVB.45.80.H03.1.454.CMB.2.raw
  modified_base (183)..(183): a, c, t, g, unknown or other
  misc_feature (183)..(183): n is a, c, g, or t
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtntccagtgtcaggtgaagttggtggagtcgtgggggagcgtggtccagccgtggggagtccctgagctctcctgtagaagtcagtggattcaacttcagtaactatgaccatacagttcgggtccnccgaggcctaccgaggacgaaggggctggagtggctgtacaagtttaattaacgaaaaaaaggtataaacgataataattaaanagaagtactaaccgaaagttaacggggcctaattcaaccctattacccaccaaggaacaacctaacgtttaaacccgaaaggtaaaacggtccgggttagttaactccgtagactaaggggtatagaacgtcaacggtcccgtaggacgtacccgaggtaaccgaccgtcgggtcttggtacttatttacgttgtacgtccaaggttagttacgttaacggcgggaacccgggaagggggagaaccgtgggttggtcccggg

SEQ ID NO: 338481 - DNA, 871 bp, Homo sapiens
  misc_feature: GZ8MTXP01B4MJG.45.80.H03.1.454.CMB.2.raw
  modified_base (320)..(320): a, c, t, g, unknown or other
  misc_feature (320)..(320): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggtccagccgtggggacgtccctgagactctcctgtgaagtcagtggattacaacttcaagtaactatcgacccaattactacgttcggggtccccnccgaaggcctaccgaggggaccggaaaggggggtccgtaggggaagttgggtaccgttggtaacgttaaaggtttaaacttttaaaaccggaaaaaaaaaaggggtaaacttaaacgtaatttaaattaaattttaaaaagtaacggtaaacgtaaaccctttacccgtaaaaggtttttaaaaccgggggacccgttaaactttaccgaaacccttacttaccccttaacccgaaagggaaaccgtaacccttaaaccgtttaaaccccgtaaaaagggaaaaccggttccgggggtttaagttacctttaccgtagtaaccgaaggggttacgtaaggtaaccggacccgtaaggccccgttaaggaacccgggcccgttacgggaaacccggaccgtacccgggttaactttcgggttaactttaaagttttacgttggtaacggaacccgttaagggaacgttaagtttaacggggtacccggggaacccgggggtaaacgggggggggtaggaaaccccgtgggggttaaccgggggttcccgggg

SEQ ID NO: 338482 - DNA, 635 bp, Homo sapiens
  misc_feature: GZ8MTXP01BUOON.45.80.H03.1.454.CMB.2.raw
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaaacacaatatggttactggtaccagcagaaggcggccaggcccctntattgataatatatctggactctaagnggcccctgagggactccccgtgacgcgtattcgtcgtggcctccccaggcgacgaggggaccaaactgtcactattcgaccatcagttggacgtccacgccgtggaaggacggaggtcgtacgacgttattactgtacgtagtacgtaaggttaacggaccacccaacctaacctacctaccgtaccggtccgtccgggttaccgggaccggggacgggaacccgaacggttccgtaccggttacccgttccgttcgggttaccgcggacccgtaacgggccctaacccggtcccccgtcgggttccctaaccgttcccgtttccccg

SEQ ID NO: 338483 - DNA, 648 bp, Homo sapiens
  misc_feature: GZ8MTXP01BTWVO.45.80.H03.1.454.CMB.2.raw
  modified_base (163)..(163): a, c, t, g, unknown or other
  misc_feature (163)..(163): n is a, c, g, or t
  modified_base (397)..(397): a, c, t, g, unknown or other
  misc_feature (397)..(397): n is a, c, g, or t
  modified_base (522)..(522): a, c, t, g, unknown or other
  misc_feature (522)..(522): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggctttttccncgttgcttcttttgagaggtgtccagtgtcaggtgaagttggtggagtcgtgggggagcgtggtccaggcctgggagtccctgagactctcctgtgaagtcagtggattcaacttcaagtaactatcgaccaatacagttcggtccgccaggcctacgaggcgaaggggctggagtggctgtactaagttaactttaacgaaaaaaaggtaataacgtaattaataagttaaanagtaacgtacctaccgaaagtttaacggggacctattaccaacctacttaccgtaccaaggtaacacctaacgttaaccgaaaggtaaacgtcgggtataactcgtagacaagggtactggaacncgaacgtccgtagacgggccctaggaaccgtacgtacgtcttgtacttagttagttgacgacgaaggttagttacgtaaggacgggaaccgggaacgggggagttaccgtgggttaacggtccggg

SEQ ID NO: 338484 - DNA, 580 bp, Homo sapiens
  misc_feature: GZ8MTXP01CSM7Q.45.80.H03.1.454.CMB.2.raw
  modified_base (285)..(285): a, c, t, g, unknown or other
  misc_feature (285)..(285): n is a, c, g, or t
  modified_base (344)..(344): a, c, t, g, unknown or other
  misc_feature (344)..(344): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagcccaccctcggtgtcagtcgtccccaggacagacgccaggatcacctgctctggagatgtctttgaccaacactaatatggttactggtaccagcaaggaaggcggccacggcccctntattgaataatatatctgactagtaagacgccctgaagggctcccgtgacgcgtattcncgtgcctacccgagcgcgaggacaaacgtgtcactagttacgacctatacgtagttcgggactccgagtccgtaggaacggacgagtctagtacttattacgtgtacaggtacgacgtaacgacccgaccaacctactactcgacgtcgtcggtcggacggtagggaaccaacgcgtaccgaccgtcgttgacgcgacccgaagcctccgccccgtggttcctccttccgtccccg

SEQ ID NO: 338485 - DNA, 583 bp, Homo sapiens
  misc_feature: GZ8MTXP01BSBUE.45.80.H03.1.454.CMB.2.raw
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
  modified_base (473)..(473): a, c, t, g, unknown or other
  misc_feature (473)..(473): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggtcttttcctacggttgcttcttttggagaggtgtccagtgtcaggtgaagttggtggagtcgtgggggagcgtggtccagccgtggggacgtccctgagactctctgtgaagtcagtgatcaacttcaagtactatgccatacngttggccnccaggcncgaggcgaaggggctggagtggtctgtntagttaacttaacgaaaaaaggtaataatataatattaaacagaacgactacagttaacgggcctattcaaccctatactacaagacactacgtacaaaggaaancgggtatactagngacaggatagacncgacgcgtagacgacgacgtacgacgacgtcgtcgttacttagttagttgtacgtacgagagacgtaaggtacggaacgggacggggacgggacggtaacgggcggtcgg

SEQ ID NO: 338486 - DNA, 615 bp, Homo sapiens
  misc_feature: GZ8MTXP01ED111.45.80.H03.1.454.CMB.2.raw
  modified_base (488)..(488): a, c, t, g, unknown or other
  misc_feature (488)..(488): n is a, c, g, or t
  modified_base (556)..(556): a, c, t, g, unknown or other
  misc_feature (556)..(556): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagcgtggtcttttcctcgttgctcttttgagaggtgtccagtgtcaggtgaagttggtggagtcgtggggggagcgtggtccagccgtgggagtccctgagactctctgtgaagtcagtggattcaattcagtaactatcgaccatacagttcgggtcccaccaggcctccgaggacgaagggggctggagtggcttgtctaagttattaacgaaaaaaagggtataaacataatattaaatagaagtactaccaagttaacgggcctaattcaacctatcctaccagacaactacttaccaaaggtaaagcggtataactctagacaggggtatcgaacncgacgcccgtggacgacccgtagaaccgacgacggtcttaagtcttagttagttgacgaccgttaagnggttaattcgggtacgggcccgggtaaaggggggacggaacgtggggttcggtcccggg

SEQ ID NO: 338487 - DNA, 635 bp, Homo sapiens
  misc_feature: GZ8MTXP01DFCWD.45.80.H03.1.454.CMB.2.raw
  modified_base (309)..(309): a, c, t, g, unknown or other
  misc_feature (309)..(309): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgcttcttttgagaggtgtccagtgtcaggtgaggttggtggggtcgtgggggagcgtggtccagccgtgggagtccctgagactctcctgtgaagtcagtgtattcaacttcagtaactatcgaccaatcagtttcgggccncgaggcctaccgaggcgaaagggggctgggagtcgcttagtctaagttaattaaacgaaaaaaggtaataactattaatatataagaatctacaagttaaaccgggctattcactatctcagacacacttacgaaagtaacgtcgtagtacttcgagactagagtcggagacacgaccgtgaccggtaccctaggaccgtaaccgtacggtccttggtctttaaagtttgttcggttcgaccgtaaggttaggttcgttacgggtaaccggggaacccggggtaaggggggacggaccggttagggttccggggccgttccggggg

SEQ ID NO: 338488 - DNA, 708 bp, Homo sapiens
  misc_feature: GZ8MTXP01BTKXR.45.80.H03.1.454.CMB.2.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagccgtggggaggtccctgagactctcctgtgaagtcaggtggattcaacttnagtaactatgccatacagttcgggtccnccaggcctccgaggcgaagggggctggagtcggctgtactaagttattaacgaaaaaaagggtaataaactaattaattaagttaataagaagtacctaccgtaaagtttaacggggcctaagttcccaaaccctaattcctaaccgaacggaacgtaaccctaactttaaccccgaaaaggtaaacggtaccgggttagttaactccggttagacctaaggggacgttaggaccgacgtaacggcccgttaacgggacgggtaccccttagggaaaccccggtacgaaccggggttccttaagggttaaccctttaaagtttacgttcgtacggtaccgaagttacgttagtaacgtcggggaacccggtaggggggaccgagtcggggttgtccggg

SEQ ID NO: 338489 - DNA, 555 bp, Homo sapiens
  misc_feature: GZ8MTXP01BBZON.45.80.H03.1.454.CMB.2.raw
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (512)..(512): a, c, t, g, unknown or other
  misc_feature (512)..(512): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagactctcctgtgaagtcagtggattcaacttcagtaactatcgaccatacattgggtcccnccagggcctccgaggcaagggggctggagtgctgtcagttattacgaaaaaggatanatatattaanagaagactaccaagttacgggcctaattcaacctatctacaganactacttaccaaagtaagccgggtatatctagactaggatgganccgagtccnggacgtcngaaccgcgacggctgtacttatacgttgacgcagngttataagggtcggccggacgggggagacctgggttcggtccg

SEQ ID NO: 338490 - DNA, 709 bp, Homo sapiens
  misc_feature: GZ8MTXP01CNRN0.45.80.H03.1.454.CMB.2.raw
  modified_base (307)..(307): a, c, t, g, unknown or other
  misc_feature (307)..(307): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggctttttcctcgttgcttcttttgagtaggtgtccagtgtcaggtgaagttggtggagtcgtggggagcgtggtccagccgtgggagtccctgagactctcctgtgaagtcagtgattcaacttcagtaactatgccatacgattcgggtcccncaggtcctaccgaggacgaagggggctaggacgttggcttgtacgtaagtttagtttaaacgaaaaaaagggtaataagattaagttaataattagaagtacttaccgtaaagtttaacgggcctaatttaccgaactacgttaccgtacccaaagtaacgaaccttaaacccgttacccgaaaaaggaaacgtccgggttagtaacctacgtagactaaagggtggtacgagtaccgaaacgtcccgtaagaccgggtccctaggaacccggaccgtacggtccgttaagttaccgttaggtttaagttcgttaaccgccgttaagggacgttaacgttaaggggtcgggaaccccggggaaaggggggttacgggaaccgtggggttccggggtcccggg

SEQ ID NO: 338491 - DNA, 771 bp, Homo sapiens
  misc_feature: GZ8MTXP01DS3LS.45.80.H03.1.454.CMB.2.raw
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagctggtcttttcctcgttgcttcttttgagaggtgtccagtgtcaggtgaaggttggtggagtcgtgggggagcgtggtccagccgtgggacgtccctgagactctccgtgtagaagtcagtggattcgaacttcaagtaactatcgacctatacagttcgggtccgccgaggcctaccgaggtacgaaggggtctagggacgtcggcttgtactaagtttattaaacgaaaaaaaagggtaataaacgtaattaattaattaaagtaagtaacggtacctacccgtaaagtttaaacggggacctacttacaaccattcctacgaagacgaacctaccttaacgaaagtaaacggtcgggttagtaactccgtagaccgtaaggtacgttagggaacacgtacggcccgttagggaaaccggtccccgttaagggaaccccgtaaacggtacccccggggtttacgtttaaccggtttaacgtttaaagttttaacggtttacggtaaccggtaaccggttaaaggttacggttaaacggttaacgggggtacccgggggtaacccgggggtaaacgggggggtacgggaaccgggttaacggggttaacccggggtccggg

SEQ ID NO: 338492 - DNA, 705 bp, Homo sapiens
  misc_feature: GZ8MTXP01DJRXS.45.80.H03.1.454.CMB.2.raw
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgctcttttgagaggtgtccagtgtcaggtgaagttggtggagtcgtgggggagcgtggtccagccgtgggacgtccctgacgactctcctgtgaagtcagtggattcaacttcaagtaactatgaccatactattgggtccgccaggctccgaggcgaaggggctggagtggctgtctagttattacgaaaaaaaggaataataataataattaaatagaagtacctaacgtaagttaaacgggaccgtaattaccacctacttacctacccaaaggaactaaccttaaccttaacccgaaaagaaacggtaccgggttagtaaattccgtaagaccaaaggggtacgtaggaacggaccgaacgccccgttagggaccggtacccccgtaggtaaacccggaacccggtaaccgggtccttaaggttacctttaaagtttaagttcggttacgaaccgttaaaggttgttaacgtaacggtacgggaacccgggggtaacgggggggagggacgtaacggggttcgggtcccggggg

SEQ ID NO: 338493 - DNA, 671 bp, Homo sapiens
  misc_feature: GZ8MTXP01DKRUK.45.80.H03.1.454.CMB.2.raw
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgcttcttttgagaggtgtccagtgtcaggtgaagttggtggagtcgtgggggagcgtggtccagcctggggacgtccctgagtactctctgtgaagtcagtgtattcaacttcaagtaactatcgacctatacagttgggcccgccgaggcctcgacgggacgaagggggtctagggagttggcttgttacgtaagtttaagttaaacgaaaaaaaggtaattaaagtaattaagtatttaaacgagtaagaccttaccgaaagtttaacgggaccctaatttaccaaccctattccacccgtaaggaactacctaaccgttaaccgaaaaggtaacggtccgggttataactccgtaaggaccaagggtacgtaggaacggccaaggcccctaaggggaccgtccgtagaaccggacgacggtcttaagttacttaagttcttgtcgcgttagcgattaagggcgggccggtaaggggggacgttacgtgggttcgggtccgg

SEQ ID NO: 338494 - DNA, 655 bp, Homo sapiens
  misc_feature: GZ8MTXP01CS7OF.45.80.H03.1.454.CMB.2.raw
  modified_base (163)..(163): a, c, t, g, unknown or other
  misc_feature (163)..(163): n is a, c, g, or t
  modified_base (250)..(250): a, c, t, g, unknown or other
  misc_feature (250)..(250): n is a, c, g, or t
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttccncgttgcttcttttgagtaggtgtccagtgtcaggtgaagttggtggagtcgtgggggagcgtggtccagccgtgggacgtccctganactctctgtagaagtcagtgattcaacttnaagtaactatgacctatactagttcgggtcccaccaggcctcgaggtcgaagggctggagtgctgtacagttattaacgaaaaaaggtaataagatataataagtagaanacgtacctaagtaacgggcctattaccaactactactaccgaagactaacctaaccgttaaccgaaagtaaacggtccggtattactacgtagacaagggtactaggacctacgacgtccgacggaccgtaccgtacgaaccgtaccgtacgttcttaacggtacttagttttacgcgttaacgacgttaagttgttaaacggttaacggtaccggggaaccggggaacggggggacgggttaacgcggggttcgggttcccggg

SEQ ID NO: 338495 - DNA, 669 bp, Homo sapiens
  misc_feature: GZ8MTXP01DQBQ8.45.80.H03.1.454.CMB.2.raw
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (500)..(500): a, c, t, g, unknown or other
  misc_feature (500)..(500): n is a, c, g, or t
tcagacgcgatcgacacgaccggtgctcgatttagctgtgcgtcgaagggaaagggggtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctctggagtatgtctttgaccaaacaacaaattagttggttactaggtaaccagcgaaggaggcggaccacggcccctntattagaattaatatatctaggaactcgtaaagacggcccctgaagggtacttcccgngtaacgcgtattctcgtgtcctcccgacggcgcgaagggaccaaaacgttgtcactattcgaacctatctaagttaggactccgagccgtggacgggacgaggtcctgtaacttaattacgngtanactacggaacgtacggaccnccaacctactacctacctacggtccgtacgggttccgggaccggtaacggggaacccaaggttccgtaccggttaccgttcccggttaggttcccgaaccggccccgtaacggggtccccttcccggtccccccgttacggttacccttcccgttccctttaacccccg

SEQ ID NO: 338496 - DNA, 626 bp, Homo sapiens
  misc_feature: GZ8MTXP01CL05Q.45.80.H03.1.454.CMB.2.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (375)..(375): a, c, t, g, unknown or other
  misc_feature (375)..(375): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggccagccgtgggacgtccctganctctcctgtgaagtcagtggattcacttcagtaactncgaccatacagttcgggtcccncgtaggcctccgagggcgaagggggctgggagtggctgtactagtttaattaacgaaaaaggtaataanattataataatagaacgacttacgagttacggcctattaccactatacctacagtacgacctacgtacaaagtaagtccggtagtactcgtacgacgtaaggggtataggacgacgtacgccggttaggaccggtccgtaggaccgaccgtacggtcgttgtacttagtttacgttgtacgaccaaggcgttaggttaacggcggggtaaccgggacggggggaggttaccggtaagggttcgggtccggg

SEQ ID NO: 338497 - DNA, 627 bp, Homo sapiens
  misc_feature: GZ8MTXP01BPUAR.45.80.H03.1.454.CMB.2.raw
  modified_base (312)..(312): a, c, t, g, unknown or other
  misc_feature (312)..(312): n is a, c, g, or t
  modified_base (506)..(506): a, c, t, g, unknown or other
  misc_feature (506)..(506): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgcttcttttgagaggtgtccagtgtcaggtgaagttggtggagtcgtgggggagcgtggtccagccgtgggagtccctgagtactctccgtgtgaagtcagtggattcaacttcaagtactatcgccatacagttcggtccgccnggcctcgaggcgaagggggctggagtggctgtacgtagtttaattaacgaaaaaaaggtacttaaagattaataatttaaagtagaagtacctaccgtaaagttaacggggcctattaccgaacctatctaccagaacgaaccaccttaaccgaaagtaaacggcgtagtatcgtgactaggatggacagtacnccgtgaggtccctggaccgaacgtccggcttaacggttattaacgtttgttgtccgtagacgttagttacgttaaggcgggaacccggtaaggggggagcgtaacgggttcgggtaacggg

SEQ ID NO: 338498 - DNA, 644 bp, Homo sapiens
  misc_feature: GZ8MTXP01BQRV0.45.80.H03.1.454.CMB.2.raw
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagccgtgggagtccctgacgtactctcctgtgagtcagtgatcaattnagtaactntcgaccatacagttcgggtccnccaggcctacgaggcgaaggggctggagtggctgtctagttattacgaaaaaggtatanatatataagagaagtactacgtaagttacgggcctattccgacctataccaccaggacaactacccgttaaccgaaagtaaacggtcggtataacgtctagacgaaggtacgtgacgacgtagacccgttagaccgggtcctaggtaccgaaccgtcgggtccttaaggttacttaaagtttacgttggtaccgtaccgaaggttacggttagttaacgggccggggaaccgggtaaacggggggggacgttaccgtaagggggttccggtaacccgggg

SEQ ID NO: 338499 - DNA, 546 bp, Homo sapiens
  misc_feature: GZ8MTXP01ASYL9.45.80.H03.1.454.CMB.2.raw
  modified_base (284)..(284): a, c, t, g, unknown or other
  misc_feature (284)..(284): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (504)..(504): a, c, t, g, unknown or other
  misc_feature (504)..(504): n is a, c, g, or t
  modified_base (530)..(530): a, c, t, g, unknown or other
  misc_feature (530)..(530): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagccgtgggagtccctgagactctcctgtgagtcagtggattcaattcagtaactangccatacattgggtccgcacgggctccgaggcgaagggggctggagtggctgtcagttattacaaaaaggatanatanattaangaancactaatagggcctatacacccagtctaccagacgatacttacaaaggaancgggtatanctgcaagggtangnacgagccnggaccggtcaggaccacgacggtctgtccgttaaagttcttaggtccganaggattataaggcggccgaggggggnaccgtgggttcgggcg

SEQ ID NO: 338500 - DNA, 602 bp, Homo sapiens
  misc_feature: GZ8MTXP01EA6QO.45.80.H03.1.454.CMB.2.raw
  modified_base (129)..(129): a, c, t, g, unknown or other
  misc_feature (129)..(129): n is a, c, g, or t
  modified_base (304)..(304): a, c, t, g, unknown or other
  misc_feature (304)..(304): n is a, c, g, or t
  modified_base (459)..(459): a, c, t, g, unknown or other
  misc_feature (459)..(459): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacncaccatggagtttgggctgagctggtcttttcctcgttgcttcttttgagtaggtgtccagtgtcaggtgagttggtggagtcgtggggagcgtggtccagccgtgggacgtccctgagtactctctgtgaagtcagtgatcaacttcagtaactatcgctatacagttcggccncaggctaccgaggacgaaggggctgggacgtggcttgtactaagtttaattaacgaaaaaaggtataaatataatattaaatagaagtactacgtaagttacgggacctattacaactactcacagacaactactaacgaaaggaacgtcggtanacttcgagacaggtatacggactcgagccgtaggacgccgtacgacgaccgtcggtcttaatcgttattacgttgaccgtagaaggttagacgttgggccggggaacgggacggggggagttaccggtgggttcgggtcccgg

SEQ ID NO: 338501 - DNA, 636 bp, Homo sapiens
  misc_feature: GZ8MTXP01CG03O.45.80.H03.1.454.CMB.2.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttcgaccaacactaatatggttactggtaccagacgaggacggcggcncgcctntatanataatatatcgtacgtactacgtagcgtccgtacgacggtctccgtagcgctcttctcgtcgtcnccgcgcgacgacgacaactcgtcatactacgactagtacgtagtcgtacgtccgacgcgtaggacggacggtacggtacgtacgtacttacgttacgttacgtacgtacgtacggtacgtacgaccgtacccctactacctaccgtaccggtaccggtccggtccgggttacggggaccgggacggtaaccgtacggttcgtaccggttccggttccgtcggaccgaccggacccgtaaccgtcccgtcccggtccccgtcgttcccgtccgttcccgtcccg

SEQ ID NO: 338502 - DNA, 530 bp, Homo sapiens
  misc_feature: GZ8MTXP02JKARL.45.80.H03.1.454.CMB.2.raw
  modified_base (274)..(274): a, c, t, g, unknown or other
  misc_feature (274)..(274): n is a, c, g, or t
  modified_base (449)..(449): a, c, t, g, unknown or other
  misc_feature (449)..(449): n is a, c, g, or t
tcagacgcgatcgacacgaccggtgctcgatttagctgtgcgtcgaagggaagggtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaaagacggccctgagggactccccgtgagcgtatttctcgtggcctccccgagccgacgaagggacaacgtgtcactattcgaccatcagttggacgtccagcctgaggacgagctgactatactgtcagtcagtacgacgccaaccactacncacgtcgcgttcggcggacggaccaagcgtacgaccgttcttcggaccacgcccaaggctccgccccgtcgtccactctcg

SEQ ID NO: 338503 - DNA, 500 bp, Homo sapiens
  misc_feature: GZ8MTXP02GA3LI.45.80.H03.1.454.CMB.2.raw
  modified_base (417)..(417): a, c, t, g, unknown or other
  misc_feature (417)..(417): n is a, c, g, or t
  modified_base (490)..(490): a, c, t, g, unknown or other
  misc_feature (490)..(490): n is a, c, g, or t
tcagacgcgatcgacacgaccggtgctcgatttagctgtgcgtcgaagggaagggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtctgggggaggcgtggtccagcctgggaggtccctgagactctcctgtgaagtcagtggattcaacttcagtaactatgccatacattggtccgccaggctccaggcaaggggctggagtggctgtcagttattcaaaaagggataacatatattatgagactcattaagggccattcaccatctcccagagacattccaagaaagcggtnatctgcagatgagcagcctgaggcctgacgacacggctgtctattatgtgccagagataagtggccagggggngacagtggcg

SEQ ID NO: 338504 - DNA, 520 bp, Homo sapiens
  misc_feature: GZ8MTXP02JTXOD.45.80.H03.1.454.CMB.2.raw
  modified_base (434)..(434): a, c, t, g, unknown or other
  misc_feature (434)..(434): n is a, c, g, or t
tcagacgcgatcgacacgaccggtgctcgatttagctgtgcgtcgaagggaaaggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctctattgataatatatctggactctaagaggccctgagggactccctgagcgattctctggctccccagcgcagggacaactgtcacattcgaccatcattggatccagcctgaggacgaggctgactattactgtacagtcagtagacgccacactacncacgtcgcgttcgcggacggaccaagctacgaccgtcctggtccacgcccgaaggcctccgcccccgtcggcctacgtccttcccg

SEQ ID NO: 338505 - DNA, 613 bp, Homo sapiens
  misc_feature: GZ8MTXP02HWNGF.45.80.H03.1.454.CMB.2.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (486)..(486): a, c, t, g, unknown or other
  misc_feature (486)..(486): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagccgtgggaggtccctgagactctcctgtgaagtcagtggattcaacttcagtaactatgccatacagttgggtccncaggctccaggcaaggggctggagtggctggtactagttatttacgaaaaaaagggtaataaacataatattanacgagactacaagttaacgggcctatacaccatcaccagagacaacttaccaaagaaacgcggtatacgtactggacagatgagcgaagcccgtagaacgggtccnggaaccgactaacgggcttggtacctttaattaatttcgggtacgtacccgaaagggtacaaacgtttaagcgggggaaccccgttaacgggggggggggaaaacgaccggtaggggtccggggacg

SEQ ID NO: 338506 - DNA, 567 bp, Homo sapiens
  misc_feature: GZ8MTXP02FPVNU.45.80.H03.1.454.CMB.2.raw
  modified_base (171)..(171): a, c, t, g, unknown or other
  misc_feature (171)..(171): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtgcgtttccacggttgctnttttagagaggtgtccagtgtcaggtgaagttggtggagtctgggggaggcgtggtccagcctggggaggtccctgagactctcctgtgaagtcagtggattcaacttcagtaactatgccatacattgggtccgccaggctccaggcaaggggctggagtggctgtcagttatttacaaaaagggaataacatatatatgagactcattaaggccgattcaccatctccagagacacttaccaagaaagcgggttatatctgcagagtagagacgacgccgtcggacggaccgtacgacgaaccgacggacgtcgttacttatttacgtttagttacgtaccgacgaagagtaagtacggaccgggacgggggacggggacggacggtcggtcgg

SEQ ID NO: 338507 - DNA, 584 bp, Homo sapiens
  misc_feature: GZ8MTXP02IUGHH.45.80.H03.1.454.CMB.2.raw
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
tcagacgcgatcgacacgaccggtgctcgatttagctgtgcgtcgaagggaaaggggtgggtccaggaggcagaactctgggtgtctcaccatggcctgggtccctctacttctacccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactntaagacggccctgagggactccccgtgacgcgtattctcgtggcctcccgagccgcgaggggacaacttgccactattcgacctatcattggacgtcacgctggaggacgaggctagtactattactgtacagttacgagtagaccgaccaacctacctactcgaacgtccgtaccggttacgggacggaacgggaaccgacggtcctacggacccgttccgttcggacaccggacctaacgggcctaccggtcccccgtacggtcctaccgttctttcccccgg

SEQ ID NO: 338508 - DNA, 536 bp, Homo sapiens
  misc_feature: GZ8MTXP02JH03R.45.80.H03.1.454.CMB.2.raw
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggcgtttcctcgttgctcttttgagaggtgtccagtgtcaggtgaagttggtggagtctgggggaggcgtggtccagcctgggaggtccctgagactctcctgtgaagtcagtggattcaacttcagtaactatgccatacattgggtccncaggctccaggcaaggggctggagtggctgtcagttattacgaaaaaggataacatatattanaganactacagtaggcatcacatctacagacacacttacaagaagcgtatatctagacagagtgacgacgacgccgtagacggcgacgacgacgacgcgtcgtactattagttgtcgacgacgagagtaagtacggacgggacggggacgggacggacggtacggtcgg

SEQ ID NO: 338509 - DNA, 573 bp, Homo sapiens
  misc_feature: GZ8MTXP02GRHJ3.45.80.H03.1.454.CMB.2.raw
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccaggccgtgggaggtccctgagactctcctgtgaagtcagtgattcaacttcagtaactatgccatacattcggtccncaggctccgaggcgaaggggctgggagtggctggtcagtttattaacgaaaaaagggtaataacataatattanagagtactactaagttaacgggcctaattcacctatctaccaganactaccttacaaagaacgtcgtagtactcgtagcaagataggagacgagccgtaggacggcctaggaccgacgacggctaggtacttagttacgttggcaccgaagtataaagtcgtcgggacccggagggggagacagggtcggaccgg

SEQ ID NO: 338510 - DNA, 511 bp, Homo sapiens
  misc_feature: GZ8MTXP02FYFDA.45.80.H03.1.454.CMB.2.raw
tcagacgcgatcgacacgaccggtgctcgatttagctgtgcgtcgaagggaaaggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatcccctgagcgattctctggctcccagcgcagggacaactgtcacattgaccatcattgagtcagcctgaggagaggctgactattactgtcagtcagtagacgaccacactactcacgtcgcgtcggcggaggaccaagctcgaccgtcttcggtcacgcccgaagctcgcccccgtcggtccaccgtctcccg

SEQ ID NO: 338511 - DNA, 537 bp, Homo sapiens
  misc_feature: GZ8MTXP02JPC4T.45.80.H03.1.454.CMB.2.raw
  modified_base (277)..(277): a, c, t, g, unknown or other
  misc_feature (277)..(277): n is a, c, g, or t
  modified_base (441)..(441): a, c, t, g, unknown or other
  misc_feature (441)..(441): n is a, c, g, or t
tcagacgcgatcgacacgaccggtgctcgatttagctgtgcgtcgaagggaaaggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactcgtaagacggccctgagggactcccgtgagcgattctctggctccccgagcgcgagggacaacgtgtcactattcgaccatcattggatccagcctgaggacgagctgactatactgtcagtcagtacgacgaccacactacncgacgtcgacggttcggcgacgggaccaaggcctcgacccgtcgttcggccacgcccgaaggtccctccggccccctaggtcctacctcgttcccg

SEQ ID NO: 338512 - DNA, 495 bp, Homo sapiens
  misc_feature: GZ8MTXP02JJ558.45.80.H03.1.454.CMB.2.raw
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggcgtttcctacggttgctcttttgagaggtgtccagtgtcaggtgaagttggtggagtcgtgggggagcgtggtccagcctgggagtccctgagactctcctgtgaagtcagtggattcaacttcagtaactatgccatacattgggtccnccaggctccaggcaaggggctggagtggctgtcagttattnaaaaaggtataacatatatangagntacataagcgatcacatctcagnacactcaagaacgngtnatcnananangaganagcgngcgcgcgacgacgacgctctctatatgtcgacgacganangngacggacggaggacgacgcgcg

SEQ ID NO: 338513 - DNA, 619 bp, Homo sapiens
  misc_feature: GZ8MTXP02FP5XQ.45.80.H03.1.454.CMB.2.raw
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagcctgggaggtccctgagactctcctgtgaagtcagtggattcaacttcagtaactatgccatacattgggtccgccaggctccgaggcgaaggggctggagtggctgtcagttattacaaaaagggaataacatatattatagagactactaagttaacgggccgtaatttaccgaacctatacctacccaagaacgtaactaacctttaccgaaaggtaaacggtcggttagtaaatccgtaggaccaagtagtggacgaccgagcccgtaggaacggcccgtaggaaccggaaccgacgggtcttacggtacttagtttagttggtacgaccgtaagagtataacggtcgggaccggaacggggggaggacgtagggtcggtaccgg

SEQ ID NO: 338514 - DNA, 606 bp, Homo sapiens
  misc_feature: GZ8MTXP02GCXTN.45.80.H03.1.454.CMB.2.raw
  modified_base (304)..(304): a, c, t, g, unknown or other
  misc_feature (304)..(304): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccaggcctgggagtccctgagctctctgtgaagtcagtgattcaacttcagtactatgaccatacagttcgggtcccnccgagggtcctccgagggcaaggggctggagtggctgtctagttaattaacgaaaaaagggtactaacataatattaatagaagactacgaagttaacggccgtattacacctatctaccagacgactacttaccaaagaacgcggtagtaactctagacagagtagacgtacgagtccgtaggacgtccgtagaccgtacgaccgggtcttcggtactttagtttacgttcggtacgaccgaggtagtagtaaggtccggggaccgggaacggggggaggtaccgtaggggtcgggtccgg

SEQ ID NO: 338515 - DNA, 633 bp, Homo sapiens
  misc_feature: GZ8MTXP02GEBK1.45.80.H03.1.454.CMB.2.raw
  modified_base (164)..(164): a, c, t, g, unknown or other
  misc_feature (164)..(164): n is a, c, g, or t
  modified_base (308)..(308): a, c, t, g, unknown or other
  misc_feature (308)..(308): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggcgttttccncggttgctcttttgagaggtgtccagtgtcaggtgaagttggtggagtcgtgggggagcgtggtccagcctgggaggtccctgagactctcctgtgaagtcagtggattcaacttcagtaactatcgaccatacattgggtccncaggctccaggcgaaggggctggacgtggctgtctagttattacgaaaaaagggaataacatatattatagagactacaagttaagggcctaattccgaccatccgtaccaagacgacaccgttaccaaaggaaacgtcgggtataactctagcagtaacgtgaacggcaagcccgtaggacggtaccctggaacccgaacgtcccggggtacttacgttacgttaagtttacgtacggtacgtaccgtaaaggtacggttaagtaacgggtccggggaaccggggtaacggggggaacggtacggtacggggtcgggtaccggg

SEQ ID NO: 338516 - DNA, 650 bp, Homo sapiens
  misc_feature: GZ8MTXP02H8MQH.45.80.H03.1.454.CMB.2.raw
  modified_base (304)..(304): a, c, t, g, unknown or other
  misc_feature (304)..(304): n is a, c, g, or t
  modified_base (434)..(434): a, c, t, g, unknown or other
  misc_feature (434)..(434): n is a, c, g, or t
tcagacgcgatcgacacgaccggtgctcgatttagctgtgcgtcgaagggaaagggctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagactctcctgtgaagtcagtggattcaacttcaagtaactatgaccatacagttcgggtccnccagggcctccgaggccgaaggggctgggagtgggctgtactaagttatttaacgaaaaaagggtaataacgaataattaattaagtagaagtaccttacctaagttaacgggcctattacaaccatccncaaggacaacctacttaaccgaaaggtaaactcgggtattacacgtagacagtagtgacgacgaacggtccgtaggacggttacccgaggaaacccggcgtaacgggtccttaggttaccttaaattttagtcggtacggtaaccaaggtacgtaagttaacggccgggggaacccggggaaggggggaacggtaccgtagggggtccggtccggg

SEQ ID NO: 338517 - DNA, 586 bp, Homo sapiens
  misc_feature: GZ8MTXP02HCSV7.45.80.H03.1.454.CMB.2.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagccgtgggagtccctgagactctctgtgaagtcagtggattcaacttcaagtaactatgaccatacattcgggtccnccaggcctccgaggcaaggggctggagtggctgtactagttattaacgaaaaaagggaataacataatattanagacgactacaagttaagggcctaattccaaccattccaccaagacgaactaacttacaaagaaagcggtatatctagacagatgagcaagccgtagacggccctggaaccgacgtacggtcttacgttacttatttactggtacgaccaaaggataagtaagtcggggaacccggtacggggggaagaccgtaagggttcgggccgg

SEQ ID NO: 338518 - DNA, 563 bp, Homo sapiens
  misc_feature: GZ8MTXP02HEXY0.45.80.H03.1.454.CMB.2.raw
  modified_base (552)..(552): a, c, t, g, unknown or other
  misc_feature (552)..(552): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagcctgggaggtccctgagactctcctgtgagtcagtgattcaattcagtaactatgccatacattcgggtccgccaggctccgaggcgaaggggctgggagtggctggtcagttattacaaaaaggtataacatatattatagagactacaagttacgggacctatacactatctaccagacacacgttaccaaagaaacgtcggtagtactcgtagactagatgagcgagccgtggacggcctagaccgacgacggtcttaggtacttatttacgtgacaccgtaggatagtaacgtcgggacccgaggggggacgaccggngggtacggcgg

SEQ ID NO: 338519 - DNA, 719 bp, Homo sapiens
  misc_feature: GZ8MTXP02GN5IC.45.80.H03.1.454.CMB.2.raw
  modified_base (292)..(292): a, c, t, g, unknown or other
  misc_feature (292)..(292): n is a, c, g, or t
tcagacgcgatcgacacgaccggtgctcgatttagctgtgcgtcgaagggaaagggggtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgctttgaccaaacaactaatagttggttactggtaaccagacaggaacgggcggccacggcccctntattagataaatatatcgtaggtactagtaaaggacggcccctcgagggtactccccgtgacgcgttattcctcgtcggcctccccgagcgacggaacggggaacaacgtgtccaactattacgaacctattacctagtttacgggacttaccgaacgtcccgtaaggggaacggacgggacggtaccgttaggtaactttaactttacgtcggtttaccaagttacgtaacggttaacgaacccggtaccccaaaccctaaccgttacctacgtacccgggttaccgtccgggttaccggggacggggaacggaaaccgaacggtccgtaccggtaaccccggttccttacggggccaacccggacccgaacgggtcccgtacccggtcccccgtacggtaccctaccggtttacctttcccccgg

SEQ ID NO: 338520 - DNA, 537 bp, Homo sapiens
  misc_feature: GZ8MTXP02H0D2F.45.80.H03.1.454.CMB.2.raw
  modified_base (303)..(303): a, c, t, g, unknown or other
  misc_feature (303)..(303): n is a, c, g, or t
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtctgggggaggcgtggtccagcctgggaggtccctgagactctcctgtgaagtcagtggattcaacttcagtaactatgccatacattgggtccnccaggctccaggcaaggggctggagtggctgtcagttattacaaaaagggtaataacatatattatagagtactcaattaaggggcctattacacccaatcctaccagacgacacttaccaaagaaagcggtagtanctagcagtatganccagcctgagcgcgacgacgacgcgtcgtctattattgttcgccgacgagagtaagtggcgacggggagggacgacggtggcgg

SEQ ID NO: 338521 - DNA, 590 bp, Homo sapiens
  misc_feature: GZ8MTXP02IIQLB.45.80.H03.1.454.CMB.2.raw
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttgggtggagtcgtgggggagcgtggtccagcctgggagtccctgagactctctgtgaagtcagtgattcaacttcagtaactatcgccaatacagttgggtcccgccaggcctccagggcgaaggggctggagtggctgtcagtttaattacgaaaaaggtaatacataatattangagctacaagttaaggggcctattacaaccattcnccagacgacacttacaagaaagcgtagtancgtanacaagatagacgcacgtccgtagacgggtccctaggaccgacgacgggtcttacggtactagtttacttggacaccgtaagacgtaagttaacggtacggggaaccgggagggggggaaacggacgtaagggtcgggtcccgg

SEQ ID NO: 338522 - DNA, 598 bp, Homo sapiens
  misc_feature: GZ8MTXP02IOLBQ.45.80.H03.1.454.CMB.2.raw
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
  modified_base (535)..(535): a, c, t, g, unknown or other
  misc_feature (535)..(535): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagcctgggagtcctgagactctcctgtnaagtcagtggattcaaacttcagtaactatgaccatacagttgggtccnccagggcctccgaggcgaaggggctgggagtggctgtctagttaattacgaaaaaaggaataacattaataattatagagtactaccaaagttaacggggaccctattaccaccaattccacccagaacgaacctacttacccaaagtaaaagcggtagtaactcgtgacgtagatgaacgcaacgccgtaggacggcctaggacgaccgacggtctagtacttaagttnttgtcgaccaaggtagaagtaacggacgggaccgggacgggggaggacggtagggtacggcgg

SEQ ID NO: 338523 - DNA, 588 bp, Homo sapiens
  misc_feature: GZ8MTXP02F2K8Q.45.80.H03.1.454.CMB.2.raw
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccaggcctgggaggtccctgagactctcctgtgaagtcagtggattcaacttcaagtaactatgccatacattcgggtccnccaggctccgaggccgaaggggctggagtggctgtcagttattacaaaaaggtatacatatattanagagtactacgattaaagggccaatttacaccctaatcctaccaagacacaccgttaccaaagaaagtcggtatatctgacaggatgagcgagcccaggacggtccaggaccgtaacgcgggcttacggtacttattacggtgtcggaacctagaggtaaccttcggtagggaccccgggaaaacgggggggttgaaccgaacggggtggtccggg

SEQ ID NO: 338524 - DNA, 585 bp, Homo sapiens
  misc_feature: GZ8MTXP02IFK13.45.80.H03.1.454.CMB.2.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
  modified_base (418)..(418): a, c, t, g, unknown or other
  misc_feature (418)..(418): n is a, c, g, or t
  modified_base (455)..(455): a, c, t, g, unknown or other
  misc_feature (455)..(455): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagccgtgggacgtccctgacgactctcctgtgaagtcagtgattcaattcagtactangccatacattcgggtccncaggcctccgaggccaaggggtctgggagtggtctggtactagttaagttaacgaaaaaagggtaataacattaatatttanagagctcaagttagggcctatcacatcacaganacacttaccaaagaacgtcggtatatcgagacgaagntgacgcagccctaggacggtccctagggacccgaacgccggtacttgtaccgttaaatttcgttgggaactaccgtaaagacgtaagtcggacgggaaccggggacgggggtagaccggtaggtcggtcg

SEQ ID NO: 338525 - DNA, 520 bp, Homo sapiens
  misc_feature: GZ8MTXP02H33TU.45.80.H03.1.454.CMB.2.raw
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtgagtcgtgggggaggcgtggtccagccgtgggaggtccctgagactctcctgtgaagtcagtggattcaacttcagtaactatgaccatacattgggtccnccaggctccgaggcaaggggctggagtggctgtcagttattacgaaaaaaggtaataacatatattataganactcattaaggcattcacatcacanagacacttacaaagaaagcgagtatctagcagatgagcagcctgacggcctgacgacacggctagcttatatgtgaccagtagataatcgggaccgagggggaaggctaaggtcggcg

SEQ ID NO: 338526 - DNA, 620 bp, Homo sapiens
  misc_feature: GZ8MTXP02HMIA6.45.80.H03.1.454.CMB.2.raw
  modified_base (328)..(328): a, c, t, g, unknown or other
  misc_feature (328)..(328): n is a, c, g, or t
  modified_base (372)..(372): a, c, t, g, unknown or other
  misc_feature (372)..(372): n is a, c, g, or t
  modified_base (554)..(554): a, c, t, g, unknown or other
  misc_feature (554)..(554): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtctgggggagcgtggtccagccgtgggagtccctgagactctctgtgaagtcagtggattcaacttcaagtaactatgcctatacagttcggtccgccaggctccgagggcgaaggggcnggaggtcggctgtactagttattaacgaaaaaagggtaataaanataattattaagtagacgtactacgaagttaacggggcctattaccaactactccgtacccaagaacgactaacccttaaccaaaggtaaacgtcgggtattactcgtacgacgaagtattggaacacgaacgcccgtaggcgtaccgtagaacggaccgacggtcctgttacttaagtttnttcgaccgacgagtagtacgttaagacggggaccggtaacggggggagtaccggaggtacggccgg

SEQ ID NO: 338527 - DNA, 597 bp, Homo sapiens
  misc_feature: GZ8MTXP02I7K60.45.80.H03.1.454.CMB.2.raw
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttacnggtacagcagaaggcggcacggcccctntattgaattaatatatctggactctaagacggccctgagggactccctgagcgtattctctggcctcccgagcgcgaagggacaacgtgtcacattcgaccattacagtttgggaacgttccgaacgtcccgtaggaacgggacgaggcctaggtaacttattacgtgtacagtacaagttacgacgccaaacccactaccgacgaccgtacgtcggttacggacggacgggaaccaacggtcgacggtaccgtccgtttacggaccgacgcccgaaggccctccgcccccgttacggtcctaccgttccgtttccccg

SEQ ID NO: 338528 - DNA, 713 bp, Homo sapiens
  misc_feature: GZ8MTXP02JS4OI.45.80.H03.1.454.CMB.2.raw
  modified_base (244)..(244): a, c, t, g, unknown or other
  misc_feature (244)..(244): n is a, c, g, or t
  modified_base (285)..(285): a, c, t, g, unknown or other
  misc_feature (285)..(285): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagtaggtgtccagtgtcaggtgaagttggtggagtcgtgggggagcgtggtccagccgtgggagtccngacgctctctgtagagtcagtgattacacttcaagtaactntcgacctatactagtttcgggccgaccgaggtcctaccggacggtacggaaggggtcgtgggtagtcggtcttaggtacgttaaagtttaaacgttaaaacggaaaaaaaggtaaataaactatttaaagttatttaagaagtacgtaaccttaacgtaaacggttaaacggggtcctaactttaacccaaccctacttacccgtaccgaagtaaccgtaaacctaaccgttacccgaaaagtaacggtacggttatacttccgtagaccgtaagtacgtagaacgcaaccgtcgtacgggaccggacccgtacggaaccggaccgtaccgggtctttaccggttacttagtttaacgttgacgtacgaaggtagtacgtaacggacgggaccggggtacgggggacgaggtacgggtcggtccgggg

SEQ ID NO: 338529 - DNA, 597 bp, Homo sapiens
  misc_feature: GZ8MTXP02GQAB0.45.80.H03.1.454.CMB.2.raw
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
  modified_base (580)..(580): a, c, t, g, unknown or other
  misc_feature (580)..(580): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagccgtgggaggtccctgagactctcctgtgaagtcagtggattcaacttcaagtaactatgccatacattgggtccnccaggcctccgaggcgaaggggtctggagtggctgtcagttattaacaaaaagggtaataacatatattanagagactacaagttacggccgattcaccatctaccagacacacttacaaagaagcgtatatctagactaggatggagacctaggcccttagggacggtcccgtacggaacgacgaccgggtccttaggttacctttaagtttaccttggttacgaccgaagtacggaattaacggtcggggaccggaacggggggacgaacggngggtacggggtcccggg

SEQ ID NO: 338530 - DNA, 589 bp, Homo sapiens
  misc_feature: GZ8MTXP02HUG02.45.80.H03.1.454.CMB.2.raw
  modified_base (404)..(404): a, c, t, g, unknown or other
  misc_feature (404)..(404): n is a, c, g, or t
  modified_base (487)..(487): a, c, t, g, unknown or other
  misc_feature (487)..(487): n is a, c, g, or t
  modified_base (577)..(577): a, c, t, g, unknown or other
  misc_feature (577)..(577): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggacgtccctgagactctcctgtgaagtcaggtgattcaacttcaagtaactatcgacctatactagttcgggtcccgccgaagggtcctcccgaagggaccgaaagggggtctgggagttgggcttggtctagttaattaacgaaaaaagggtaataacgataatattanagagactcaagtacggccgtattcaacatctaccagagacacttacaaagaacgtcggtatatctagctaagagttaggaacncgacgcgtaggaacgcgtaggaaccgacgtacgggcttaggtacttagttacttgcgacctagagtagaacgtcggaccggacggggganacgaggtcggcg

SEQ ID NO: 338531 - DNA, 629 bp, Homo sapiens
  misc_feature: GZ8MTXP02HXFND.45.80.H03.1.454.CMB.2.raw
  modified_base (320)..(320): a, c, t, g, unknown or other
  misc_feature (320)..(320): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (546)..(546): a, c, t, g, unknown or other
  misc_feature (546)..(546): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagccgtgggacgtccctgagactctcctgtgaagtcaggtggattcaacttcaagtaaactatcgacctaataacctagtttcggggtcccnccgaagggcctaccgaagggacgaaaggggctagggagtggctggtactaagtttaagttaaacgaaaaaaaaaggggtaaataaactaataaattaattaagtagaacgtactacaaagttaaacggggcctaattacaaccctatccacaagacacacttacgaaagaagcgtattanctagcaagntgaanccgagcgtaggacgccgtagaaccgcgacggnttacgtacttagttactggtacgacctaagaagtataacggtacgggaaccggaaggggggacaaacggtgggtacggccggg

SEQ ID NO: 338532 - DNA, 638 bp, Homo sapiens
  misc_feature: GZ8MTXP02ILOSQ.45.80.H03.1.454.CMB.2.raw
  modified_base (302)..(302): a, c, t, g, unknown or other
  misc_feature (302)..(302): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggaggtccctgagactctcctgtgaagtcagtggattcaacttcagtaactatgccatacatgggtccncaggctcaggcaaggggctggagtggctgtcagttaattacgaaaaaaggtaataacataataattaatagaagtactacaagttaaacgggccgtaatttaccaaccgaattcctaccaagtaacgaacctaaccgttaaccaaaaggtaaaacgtcggtagtaatcgtagacgagaatggaagcaacgccgtaggaacgtcccgtaggaacccgtacgaccggggtcttacggttaccttaaagttttactacggttacgacccgtaaggtaacgtagttaaacgtccgggggacccgaacgggggggaaggacccgtaagggttcgggaccgg

SEQ ID NO: 338533 - DNA, 540 bp, Homo sapiens
  misc_feature: GZ8MTXP02FR3TU.45.80.H03.1.454.CMB.2.raw
  modified_base (365)..(366): a, c, t, g, unknown or other
  misc_feature (365)..(366): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (487)..(487): a, c, t, g, unknown or other
  misc_feature (487)..(487): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccaggcctgggaggtccctgagactctcctgtgaagtcagtggattcaacttcagtaactatgccatacattggtccgccaggctccaggcaaggggctggagtggctgtcagttattacaaaaaggaatacatatatannagcncataggcatcacatcncaganacactcaaagaagcgtatantagactagactagagacagccctggacgcctggaaccgacgacggtctagtactagtttgttacgtcgtccgaagngaagttaagtcggggaccggacggggggtacgaggtaacgggtcgggtacggg

SEQ ID NO: 338534 - DNA, 579 bp, Homo sapiens
  misc_feature: GZ8MTXP02G23YN.45.80.H03.1.454.CMB.2.raw
  modified_base (305)..(305): a, c, t, g, unknown or other
  misc_feature (305)..(305): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagctctctgtgaagtcagtggattcaacttcagtaactatcgaccatacagttcgggtcccncgaggcctccgaggcgaaggggctggagtggctgtctagttattaacgaaaaaggtataacatatattatagagtactactagttaacgggcctattaccaacctatcctaccgagacgaactacttaccgaaaggaaacgtcggtagtatcgtaggacagagtgagacgagccgtaggacgctacggacgacgacggtcttagtactagttactgacgtaccgagtagtaacgtgtcgggaccgggtagggggaggaccgtagggtcggccgg

SEQ ID NO: 338535 - DNA, 546 bp, Homo sapiens
  misc_feature: GZ8MTXP02G3G7I.45.80.H03.1.454.CMB.2.raw
  modified_base (505)..(505): a, c, t, g, unknown or other
  misc_feature (505)..(505): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagctctcctgtgaagtcagtggattcaacttcagtaactatgccatacattagggtccgccagggcctaccgaggcaaggggctggagtggctgtacagttattacgaaaaaggaataacgatatattatagagactacagttaaggccgtatacactatctaccagaacgacacttaccaaagaaagcggtagtactctgacagatagacgcacgcctaggacgtccagacgacgacggctgtctattctagtcgtacganagtatgtcggacccgggagggggaggtacgaggtacggcgg

SEQ ID NO: 338536 - DNA, 548 bp, Homo sapiens
  misc_feature: GZ8MTXP02JB4TO.45.80.H03.1.454.CMB.2.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (540)..(540): a, c, t, g, unknown or other
  misc_feature (540)..(540): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggagtccctgagactctcctgtgaagtcagtgattcaactnagtaacatgccatacagttcgggtccncaggcctccgaggcgaaggggctgggagtggcttgtctagttaatttaacgaaaaaagggtaataaacataataattanagagactcaagttaacgggctatcacatctaccagaacgcaacttaccaaagaacgcggtatactctagcagatgagcagcctgacggcctgaccganacggtnttcgacttaatcttcgcgtaccagtacgataaggtcggaccggagggggagaccgnggtcggcg

SEQ ID NO: 338537 - DNA, 518 bp, Homo sapiens
  misc_feature: GZ8MTXP02F5YW2.45.80.H03.1.454.CMB.2.raw
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatcccctgagcgattctctggctccccagcgcgagggacaactgcacattgaccatcattggatccagcctagaggacgagctagacttatactgtacagtcagtagacgaccaccactactcacgtcgcgttcggcggaggaccagctcgaccgtcttcggtcacgcccgaagcctcgccccctggtccactccgtacccg

SEQ ID NO: 338538 - DNA, 612 bp, Homo sapiens
  misc_feature: GZ8MTXP02JPFQV.45.80.H03.1.454.CMB.2.raw
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (402)..(402): a, c, t, g, unknown or other
  misc_feature (402)..(402): n is a, c, g, or t
  modified_base (488)..(488): a, c, t, g, unknown or other
  misc_feature (488)..(488): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagtaggtgtccagtgtcaggtgaagttggtggagtcgtgggggagcggtggtccaggccgtggggacggtccctgacgtacctctccgtgtgaagtcagtggattcaacttcaagtaactntacgaccaatactacgttcgggtcccnccgaggtcctccgaggcgaaggggctggagtggctgtactagtttaataacgaaaaaaggtataacgattaatattanagagtacttacaagttaacgggctagttacacactcctacaagacgactaactacgaaagaagacggtatactcgtgacaggtacnggacgcgaacgccgtaggacgtcgacggaccgacggacgtcttagttacttaattcgtttcgacgtacgaagtgtaagttcggacgggacccggagggggacgtacggtaggggtcggtccggg

SEQ ID NO: 338539 - DNA, 667 bp, Homo sapiens
  misc_feature: GZ8MTXP02GN8MK.45.80.H03.1.454.CMB.2.raw
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (434)..(434): a, c, t, g, unknown or other
  misc_feature (434)..(434): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagcgtggcttttcctcgttgctcttttgagaggtgtccagtgtcaggtgaagttggtggagtcgtgggggagcggtggtccagccgtgggacggtccctgagactctcctgtgaagtcagtggattcaacttcagtaactntgaccatactattcgggtcccncaggcctccgaggcgaaggggctggagtggcttgtacaagttaatttaacgaaaaaaagggtaactaagaataattaattagtagacgtactacctaagttaacggctatcacatctacaganactactacgaaagtaagtcggtatactcgtagacagatagacgacacgtcccgtagggaacgtccgtaacggaccggaaaccgtacggggtccgttacgtttaaactttaacggtttaaactttgggtacgtacccgtaaaacgacgttaaacgtttaagggtaaccggggaaccccgggggtaaaagggggggtaaccggacccggtaaacgggggttccggtccccggggg

SEQ ID NO: 338540 - DNA, 573 bp, Homo sapiens
  misc_feature: GZ8MTXP02FZK09.45.80.H03.1.454.CMB.2.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (436)..(436): a, c, t, g, unknown or other
  misc_feature (436)..(436): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggtccagcctgggagtccctgagctctcctgtgaagtcagtggattcaacttcagtaactatcgaccatacagttggccnccaggcctccgaggcgaaggggctggagtggctgtcagttattaacgaaaaaggtaatacatatatanagagactacgtaagttaacggccgtattcaaccatctaccaagacactactacgaagaaagcgtntatctagcagatgagcagcctggacgctacggacgacgacggctagtacttagtttacgttcggacgtaccgaaggacgtaataacgggtacggggaacccggggacgggggtaaggtacggaggtcggggtcccgg

SEQ ID NO: 338541 - DNA, 803 bp, Homo sapiens
  misc_feature: GZ8MTXP02IBOOY.45.80.H03.1.454.CMB.2.raw
  modified_base (290)..(290): a, c, t, g, unknown or other
  misc_feature (290)..(290): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagcgtggtcttttcctgttgcttcttttgagaggtgtccagtgtcaggtgaaggttggtggaggtcgtgggggaggcgtggtccaggcctgggacgtccctgagctctctgtgaagtcaggtgattcaacttcaagtaaactntcgacctatacgagtttcggggtcccgaccgtagggcctacccggagggtaccggaaacgggggtcgtaggggaggtcgggtctggttaccgtaaaggttttaaagtttaaacggaaaaaaaaaggggtaaacttaaaactaattaaattaagtttaaataacgggtaaactaaccgttaccctaaaagggtttaaaaaccgggggcccttaaaactttccaaaccctaaccctttacccgtaaaccccaaagggtaaaccgtaaaccctaaacccgtttaacccgaaaaaggggtaaacgtcggggttaacttactacgtacggacaaaggtagtcgaaagcgacgtccgtaagacgggtcctacgggaccgtaccgacgggtccttggttaccttttaggttacgtttacggaccggttaccaagggtaacgtaaggtttaacggggtccggggtaacccgggggaaaacgggggggtacggtaccggtaacggggtcgggtaccccgggg

SEQ ID NO: 338542 - DNA, 688 bp, Homo sapiens
  misc_feature: GZ8MTXP02FZAF6.45.80.H03.1.454.CMB.2.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagtaggtgtccagtgtcaggtgaaggttggnggagtcgtgggggagcgtggtccaggccgtgggacgtccctgagctctcctgtgaagtcaggtgattcaacttcaagtaactntcgacctatactagttcgggccnccaggcctccgaggccgaaggggtctaggagtggcttgtcgtaagtttaacgttaacgaaaaaaggtaataactataattaattaagagtaacgtaccttacgtaaaggttaaaccgggccgttaaacttaccgaaaccctactacccgtacccgaagtaaccgtacctaacgttaaacccaaaggtaaaacgtcgggtaatacgtcttacggactaagtacgtagacgacgtaacggtccgtaggaccggtacgtaacggacccgtaacgaccgggtcttacgtacgttaagtttacgtaggtacgaccgaaacgtggtaacgtaacggcgggtaaccgggggaacgggggacgtaccggtaggtcgggtacgg

SEQ ID NO: 338543 - DNA, 553 bp, Homo sapiens
  misc_feature: GZ8MTXP02FH7V4.45.80.H03.1.454.CMB.2.raw
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggagcgtggtccagcctgggaggtccctgagactctcctgtgaagtcagtggattcaacttcagtaactatgccatacagttgggtcccgccaggcctccgaggcgaaggggctggagtggctgtcagttattacgaaaaaggataacatatatatgagactacataggctattccaactatctaccagacacacttaccaaagaaagcgtagtatcgtagcaagtagtagacgtcaagccctggaacggcctggaaccgaacgcggctcgtacttaatttcgttgaccacgtaaggctaagtggcggaccggacggggggagaccgnggnggtccgg

SEQ ID NO: 338544 - DNA, 657 bp, Homo sapiens
  misc_feature: GZ8MTXP02F015Q.45.80.H03.1.454.CMB.2.raw
  modified_base (281)..(281): a, c, t, g, unknown or other
  misc_feature (281)..(281): n is a, c, g, or t
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatattggttactggtaccagcaggaaggcggcacggcccctntatgaataatatatctggactcgtaaagcgccctgagggactcctgagcgtattctctggcctcccgagccgacgacgggacaacgttcgtccatacttacgacctatctagttcgggatcccgacgtccgtaggaggacgaggctaggaactttagttacgtcgtactagtacgtaacgtacgaccgtacccaaccctacctacctacgtaacccggttcgacccgggtttacgggaccgggtaacggggaaacccgaacggtccgtaccgggtaacccggttccgtttacgggtacccgaccggaccccgtaaaccgggtcccgttaccccggtacccccgtccgggtaccctaacccgttccctttacccccg

SEQ ID NO: 338545 - DNA, 708 bp, Homo sapiens
  misc_feature: GZ8MTXP02FT7R1.45.80.H03.1.454.CMB.2.raw
  modified_base (212)..(212): a, c, t, g, unknown or other
  misc_feature (212)..(212): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgngggggagcgtggtccagccgtgggagtccctgagactctcctgtgaagtcaggtggattcaacttcaagtaactatacgacctaataactagttcggggtcccgaccgagggcctcccgaagggaccgaaagggggtcctagggacggtcgggcgttacggtacgtaaaggtttaaactttaaaacggaaaaaaaaacggggtaaattaaaaccgtaaattaaattaaattaagttaagaaacgtaaccttaaccggtaaagtttaaaccgggggccttaaacttaccaaccctattacccgtaacccaagtaacgtaacctaacctttaaccgaaaggaaacgtccggtagtactccgttaggacaagacgtggaacacgtaacgccgtaggacgccgtagacccggacgtacgggccttaggttacttatttacgtgtcgaccgtagactaagtaacggcggaccgggacgggggaagacgtacggtcggacgg

SEQ ID NO: 338546 - DNA, 781 bp, Homo sapiens
  misc_feature: GZ8MTXP02HPGV9.45.80.H03.1.454.CMB.2.raw
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagccgtgggacggtccctggagactctcctgtgagtcngtgattcaacttcagtaactatcgccatacagttcgggtcccnccgagggtcctccgagggccgaagggggtcctaggggagttgggcttggtacgtagtttaagtttaacgaaaaaaggggtaaattaaaccgaatttaagttaatttacgtaaggtaacggtaccttaccgtaaagtttaaaccgggggacccttaaatttcccaaacccgtaaattcccgttaaccccgaagaaccggaaaccttaaacccgtttaacccgaaaaacgggttaaaaccggtccggggttaagttaaacgttccgttaacggtaacccgaaggtaagtttacgggaacgaccgaaaccggtcccgttaaggggaccgtaaccggtacggaaacccggtaccggaccgggtcgtttaacggttcttttaaacgttaccgttagggttcacccgtaaggaacggttataacgggtcggggaaccccgggtaggggggaaccgttacgacgggggtacggtccggg

SEQ ID NO: 338547 - DNA, 570 bp, Homo sapiens
  misc_feature: GZ8MTXP02JFHC1.45.80.H03.1.454.CMB.2.raw
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagcgtgcgtttcctacgttgctcttttgagaggtgtccagtgtcaggtgaagttggtggagtcgtgggggaggcgtggtccagcctgggaggtccctgagactctcctgtgaagtcagtggattcaacttcagtaactatgccatacatttgggccnccaggctccaggcaaggggctggagtggctgtcagttatttacgaaaaaaggataacataatattatagagactacagttaaacggggcctattcaccctaatctaccaganaccacttacccaagaaagcggttgtactntgacgagatagagacgacgcgtacgacggcgtacgacgacgacgtcgtacgtacttattacgttagtcgtacgacgagtagtaagtacggacgggacgggggacgggacggtacggtacggtcgg

SEQ ID NO: 338548 - DNA, 578 bp, Homo sapiens
  misc_feature: GZ8MTXP02FKKP1.45.80.H03.1.454.CMB.2.raw
  modified_base (280)..(280): a, c, t, g, unknown or other
  misc_feature (280)..(280): n is a, c, g, or t
  modified_base (374)..(374): a, c, t, g, unknown or other
  misc_feature (374)..(374): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccaggccgtggggacggtccctgagactctcctgtgaagtcagtggattcacttnagtaactatgaccatacattggtccgccaggcctccgaggcgaaggggctggagtggctgtcagttattaacaaaaaggtaataacatatatanagagactacattaacggctattacacctatctcaganacacttaccaaaggaaagtcggtatactacngtacgagatgagtcgagcccgtaggacggtacctggaaccgtaccgacgggtccttaggtaccttatttagttggtacgaccgtagagtacgtaagtcggggaaccggacggggggacggtacgaggttcggccgg

SEQ ID NO: 338549 - DNA, 753 bp, Homo sapiens
  misc_feature: GZ8MTXP02JXZGQ.45.80.H03.1.454.CMB.2.raw
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgaccaaacactaatatggttactggtaccagcgaaggaagggccggccacggtccccctatagttgaataatatatctaggactacgtaagcggtccctagacgggtactccccgtgacgtcgtatttccgtcgtcggtacctccccgagtccggacgaacggggtacctaaacgtcgttacaacctagttaccgacctagtaccgtagtttcggaaacgtccgtaaacgcccgtaggaacgggaacgtacggtaccgtagaaccgtttaacgttacgtacgttacgacgttagaacggtaacgacccgaccccaactacctttaaccgaccgtaccggttccggtaccgggtttaccgggaaccggggtaaaccgggtaccgaaaacgggtcccgtaaccgggttaaccccggttcggtttaccgggtaccgtaaccggtaaccccggaaaccgggtccccgttaaccccggggccccccgtttacgggacccccttaaccgtttccccggtttccccccgg

SEQ ID NO: 338550 - DNA, 710 bp, Homo sapiens
  misc_feature: GZ8MTXP02G0UYK.45.80.H03.1.454.CMB.2.raw
  modified_base (429)..(429): a, c, t, g, unknown or other
  misc_feature (429)..(429): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttcctcgttgcttcttttgagaggtgtccagtgtcaggtgaagttggtggagtcgtgggggagcgtggtccaggccgtgggagtccctgagctctctgtgaagtcagtgattcaacttcaagtaactatacgacctaatacctagtttcggggcccgtccgaaggtcctaccgaagggaccgaaagggggtcgtggggacgtggcttaggtacttaaggttaaagtttaaacggaaaaaaagggtaaaactaaacaagttaataagtttaanagtaaacgtcttaaccgaaagtttaacgggaccctaatttaccacctaattccaccgaaagtacgaacctaacccgttaaccaaaaggtaaacgggtcgttagtacgtccgtaaggcaaaggtaatggaaacggcaaacgggtcctaagggccggtaccgtaggacccggtacgaaccggtcgttagtaccgttaattaccgttggtacgacccaagtaaggtacgtaaggtacccgggaaaccgggtacggggggaagaaaccggtggtcgggtacccgg

SEQ ID NO: 338551 - DNA, 679 bp, Homo sapiens
  misc_feature: GZ8MTXP02IGNKN.45.80.H03.1.454.CMB.2.raw
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (348)..(348): a, c, t, g, unknown or other
  misc_feature (348)..(348): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgcttcttttgagaggtgtccagtgtcaggtgaaggttggtggagtcgtgggggaggtcggtggtccagccgtgggacggtccctgagactctctgtgaagtcagtggatcaacttcagtaactatgccatactagttcggggccnccgaggtcnccgaggcgaaggggctagggagtcggntgtactaagttaataaagaaaaaggtaataaactataataacttagaagatacctaacgtaaagttacgacctataccacctactacctaccaagtaacgtacctaaacgttacccaaaggtaaacggtacggttacgtagtacgtacgtacgtaagtaagtagacggacgtaacgtaccgtacggacggtaccggtaccggaaccggaaccggtaccggtacgtacgttacgttaagtttacgttacgtacgtaccgtacgtaacgtaagtaacggtacgggtaccggggaacgggggaacggggtacggtacgggtacggggtccgggg

SEQ ID NO: 338552 - DNA, 622 bp, Homo sapiens
  misc_feature: GZ8MTXP02IDIW9.45.80.H03.1.454.CMB.2.raw
  modified_base (206)..(206): a, c, t, g, unknown or other
  misc_feature (206)..(206): n is a, c, g, or t
  modified_base (309)..(309): a, c, t, g, unknown or other
  misc_feature (309)..(309): n is a, c, g, or t
  modified_base (418)..(418): a, c, t, g, unknown or other
  misc_feature (418)..(418): n is a, c, g, or t
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttggctgagctggctttttcctcgttgcttcttttgagaggtgtccagtgtcaggtgaaggttggnggagtcgtgggggaggcgtggtccagccgtgggacgtcctgagctctctgtgaagtcagtggattcaacttcaagtaactatcgccatactattcggggtccncgagggctaccgagggaccgaagggggtctggagggttcggtcttggtacctaagttttaactttaaaacgaaaaaaaaggggtaattaaacgtataattaactttaanacgtagtacttacaagtttaaaggggcctatttcaaccctattccacgaanacgacctacgttacaaagtaaagccgtagtacttccaganagagtacgacacgngcgnggacgacgacgacgacgtacgtcttactacttattacgtcgacgaccgtagtagagtcggacggacggggacggggaagtcggcggtacggtcgg

SEQ ID NO: 338553 - DNA, 630 bp, Homo sapiens
  misc_feature: GZ8MTXP02H8RIY.45.80.H03.1.454.CMB.2.raw
  modified_base (256)..(256): a, c, t, g, unknown or other
  misc_feature (256)..(256): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgctcttttgagtaggtgtccagtgtcaggtgaagttggtgagtcgtgggggagcgtggtccagccgtgggacgtcctgagactctctgngaagtcagtggattcaacttcaagtaactatgccatactagttcgggtccgccagggcctaccgaggacgaaggggctgggagtggtctggtctaagttacgtttaacaaaaaaagggtaataaacgtataacgttattaagagaactacgttaacaacgtttaaacggggaccctaatactaccacgttcacgtagaacactaaccttacgaaaaggaaacgtcggtaagttctacgtagccaagtataggaacgacgaagtcccgaggaaccggccaacggaccgtacgacgggtcttggtacctttagtacttgggctacgaagtagattcggacggaccggggtacggggggagacggtaggtacggcgg

SEQ ID NO: 338554 - DNA, 840 bp, Homo sapiens
  misc_feature: GZ8MTXP02IIFPZ.45.80.H03.1.454.CMB.2.raw
tcagacgcgatcgacacgaccggtgctcgatttagctgtgcgtcgaagggaaagggggtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgaccaacacaatataggttactggtacagcagacggcggccacggcccctactatgaataatatatctggactcgtaagacggccctagaggtactccccgtagacgtcgtactttccgtacgtggtccttccccgacggccgcgaacggggaacctaacgttcgtacctaacgtaatttaccggaaccctaagttccgaagtttacgggaacgttacccgaacggtacccgtagggaacgggtaaccgggtacgggtaccgttacggtaaaccgtttaacgtttaaaccgttacggttaaccgttaaaccggttaccgttaaacgggtttaaccggaaccccggtaacccctaaacccgtaacccgttaacccgttacccggtaacccgggttaccgggttaccgggtttaccgggggaccggggtaaaaccgggggtaacccgtaaaacgggtacccggttaaccgggttaaccccgggtttaccggttttaccggggtaacccgttaaccgggacccccggttaaaacgggtccccgttaccccgggtacccccccggtttacggggttacccccttaacccggtttacccgttttccccccgggg

SEQ ID NO: 338555 - DNA, 593 bp, Homo sapiens
  misc_feature: GZ8MTXP02HKDOH.45.80.H03.1.454.CMB.2.raw
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggtcttttcctcgttgcttcttttgagaggtgtccagtgtcaggtgtaagttggtggagtctggcgggaggcgtggtccagccgtgggacgtccctgagacctctcctgtgaacgtnagtggtatanaactcagtactanagacctatacgtagttgggtcccgaccgacggcctccgaaggcgtaaggggctgggagtggctgtactacgttaattaaccgaaaaaaggtaataacattaatattatagaatactactagtaagggaccattacaacatacctacaagcgaactacctacaaagtaagtcgtagacttacgatacgagaactgaagccgtacgcgtacgtacggcgacgacgtcacggtctacggtctattcgtagttcgactaaggataagtacgtcgggaacgggtaagggacggacgttagggccgg

SEQ ID NO: 338556 - DNA, 649 bp, Homo sapiens
  misc_feature: GZ8MTXP02IOID7.45.80.H03.1.454.CMB.2.raw
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (419)..(419): a, c, t, g, unknown or other
  misc_feature (419)..(419): n is a, c, g, or t
tcagacgcgatcgacacgaccggtgctcgatttagctgtgcgtcgaagggaaaggggtctgggagacgagccccagcactggaagtcgccggtgtttccactcggtgatcatcaccgaacacagaggacgcaccatggagtttgggctgagctggcttttcctcgttgctcttttgagaggtgtccagtgtcaggtgaagttggtggagtcgtgggggaggcgtggtccagcctgggaggtcctgagactctcctgtgaagtcagtgattcaacttnagtactangaccatacattcgggtccgccaggcctccgaggcgaaggggctggagtggctgtctagttattacgaaaaaggtaataacataatattatagacgtactactaagttaacggaccgtattaccacctattaccnccctaagacacctaacttaaccgaaaagtaaaacgtcggtaagttactacgtacgacctaaggagtacgacgtcgaaacggtccctagggacggtcccgtaaggaccaaacggcggtctttacgtacttttaaagttcgtttacggactacccgaaagtacgaagtttaacggaccgggggtaccggtaaaacggggggggtacggaacgtcgggggtacggtaccgggg

SEQ ID NO: 338557 - DNA, 614 bp, Homo sapiens
  misc_feature: GZ8MTXP02H57DE.45.80.H03.1.454.CMB.2.raw
  modified_base (403)..(403): a, c, t, g, unknown or other
  misc_feature (403)..(403): n is a, c, g, or t
  modified_base (434)..(434): a, c, t, g, unknown or other
  misc_feature (434)..(434): n is a, c, g, or t
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
  modified_base (545)..(545): a, c, t, g, unknown or other
  misc_feature (545)..(545): n is a, c, g, or t
tcagacgcgatcgacacgaccggtgctcgatttagctgtgcgtcgaagggaaagggggtgggtccaggaggcagaactctgggtgtctcaccatggcctgggtccctctacttcctccccctcctcactctctgcacagggtctgaggcctcctatgaggtgacacagccaccctcggtgtcagtcgtcccaggacagacgccaggatcacctgctctggagatgtctttgaccaaacacaatagtaggttactggtaccagcaggaacggcggccacggcccctactatagatatatactcgtagactacgtaagcgtcccgtagagggacttccgaggagtctacgttctcgtcggctccccgagccgacgacggacaactcgacactagttacaccaatnacgttagactccgacgtcgaggagacgacgntagtaacttattacgntacgatagagtacacgaccctacactacgtaccncggtacgtcgtacggacgggaacgtaccgaagtccaccggtaccctaccggttcgaacccnccggacccgtaacggtccccggtacccgtcccccgttccgggtaacctccgtttaccccggttcccccg

SEQ ID NO: 338558 - DNA, 541 bp, Homo sapiens
  misc_feature: GZ8MTXP02GIPRZ.45.80.H03.1.454.CMB.2.raw
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgtgctgagctggcttttcctcgttgctcttttgagaggtgtccagtgtcaggtgaagttggtggagtcgtgggggagcgtggtccagccgtgggaggtccctgacgactctcctgtgaagtnagtgatcattcagtacatgccatacagttgggtcccncgaggcctaccgaggcgaaggggctgggagtgctgtnagttattaacgaaaaaggataacatataatatgaaagactacgaattacgggctattacactatctcaganacctatcgaagagntgntatnanagatgagcacgacgtgacgctagacgacacggtactcggtaattcgtttacgtgtacgacaaggagtaagttacgacggacccgggaagggggacggacggaggtcggg

SEQ ID NO: 338559 - DNA, 548 bp, Homo sapiens
  misc_feature: GZ8MTXP02GHW5S.45.80.H03.1.454.CMB.2.raw
  modified_base (162)..(162): a, c, t, g, unknown or other
  misc_feature (162)..(162): n is a, c, g, or t
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttccncgttgctcttttgagaggtgtccagtgtcaggtgaagttggnggagtcgtgggggagcgtggtccaggcctgggaggtccctgagactcgtcctgtgaagtcagtgattcaacttcagtaaactntgccatacattggccgccagggctccaggtcaaggggctggagtgctgtcaagttattacaaaaaagggtataacaatatatattaanagactactaagtagacatacacancacananacactacaanaagagagtatnananagagtagagacagcgtacgacgtcgacgacgacgacgtcgtacgtactatacgtcgtacgaccgtacgtaagtaagtaagtacggacggacggggacgggacggtacggtacggtcg

SEQ ID NO: 338560 - DNA, 829 bp, Homo sapiens
  misc_feature: GZ8MTXP02GDS4G.45.80.H03.1.454.CMB.2.raw
  modified_base (162)..(162): a, c, t, g, unknown or other
  misc_feature (162)..(162): n is a, c, g, or t
  modified_base (289)..(289): a, c, t, g, unknown or other
  misc_feature (289)..(289): n is a, c, g, or t
  modified_base (317)..(317): a, c, t, g, unknown or other
  misc_feature (317)..(317): n is a, c, g, or t
tcagacgcgatcgacacgaccggtgctcgatttagctgtgcgtcgaagggaaaggggtctgggagacgagcccagcactggaagtcgccggtgtttccactcggtgatcatcaccgaacacagaggacgcaccatggagtttgggctgagctggcttttccncgttgcttcttttgagaggtgtccagtgtcaggtgaagttggtggagtcgtgggggagcgtggtccaggccgtgggagtccctgagctctctgtgaagtcagtgacttcgaacttcgaagtaaactntacgctaatacgtagttacggggtcccnccgaagggtccctaccgacggggtacgaaaacgggggtcctaaggggagtcggggctttacgggtacttaaacgggtttaaacgttttaaaaccggaaaaaaaaaaggggtaaccttaaaaacgtaatttaaacgtttaaaatttaaacggaaggtaaaccggtaaacccttaacccgtaaagggtttaaaacgggggtaccccttaactttaccgaaaccctaaagttccctaacccgtaaaggaacgtaaaccttaaccgttaaacccgaaaaggaaacgttcccggggtaattaaacgtccgttagggaactaaggtaagttcgggacaaccggtacggttacccggtacgggaccggtaccgtacggaacccggtaccggtaccggtaccgttacgtttaaccgtttagttaccgttacggtaccgtaccgtaaagtaacgtaacggttaacggaccgggggaacccggggtacgggggaacggacggtacgggggtacccggtccgg

SEQ ID NO: 338561 - DNA, 726 bp, Homo sapiens
  misc_feature: GZ8MTXP02HGUDN.45.80.H03.1.454.CMB.2.raw
  modified_base (409)..(409): a, c, t, g, unknown or other
  misc_feature (409)..(409): n is a, c, g, or t
  modified_base (526)..(526): a, c, t, g, unknown or other
  misc_feature (526)..(526): n is a, c, g, or t
tcagacgcgatcgacacgaccggtgctcgatttagctgtgcgtcgaaggggaaaggggtctgggagacgagcccagcactggaagtcgccggtgtttccactcggtgatcatcaccgaacacagaggacgcaccatggagtttgggctgagctggcttttcctcgttgcttcttttgagtaggtgtccagtgtcaggtgaagttggtggagtcgtgggggaggcgtggtcagccgtgggacggtccctgagactctctgtagagtcagtggattcaaacttcaagtaactatcgacctatactagttcggggtcccgtaccaggccctaccgagggacgaaggggctagggacgtggctgtactaagttaattaaacgaaaaaagggtaataactattaattaacttanaagtactctaacgtaaagttaaacggggcctaatttacccaacgtacttaccctaacccgaaaggacctaaaccttaaacccttacgaaaaaggaacggttcgtaagtacttaccgnggaaccgtagtaagtgggaacctacccgaaagtcccggtaaacggcggtaccctaggaacccggactaacgggggttaccttgggttaactttaagttttagtcgggaaaccgtcctaaaacgggattaacggttcgggaacccgggtaacccgggggaaaggggggtacccgaaagggtacgggtttacgggccggggg

SEQ ID NO: 338562 - DNA, 532 bp, Homo sapiens
  misc_feature: GZ8MTXP01D5RRJ.38.27.C05.1.454.CMB.2.raw
  modified_base (224)..(224): a, c, t, g, unknown or other
  misc_feature (224)..(224): n is a, c, g, or t
  modified_base (476)..(476): a, c, t, g, unknown or other
  misc_feature (476)..(476): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctnagtgattgtcccctgccaggcttccggatatatcttcgacttctactattacactgggtgcgccaggtcccctggacaaagggcctgagtggatgggatgcatcaaccccagaactggcgacacaaagtctgcaacagaagtttcagggcaggggtcaccatcgacccgagacacgtcatcaaatacagcctacctgaactcagctaccctaaaatcctagacgacacggccgtactattactgtgcgaagnggcagagttccattggttattaagtgtcgttttcgatggttcttttgaattttcgg

SEQ ID NO: 338563 - DNA, 637 bp, Homo sapiens
  misc_feature: GZ8MTXP01EV2KZ.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggagccgtgggcctcagtgattcgtcccctgccaggtcttccggatatatcttcgacttctactattacactgggtgcgccaggtcccctggacaagggcctgagtggagtgggatgcataccaaccccagaacgtggacaaccaacaaagtctgaccaaacaaggtaacgtttcgaaggggtcgacggggtaccacgagtacgacccgagaaccacgtaccaatacaaactaccacgtaccctaaccgtacggaaacctacgacgtaccttaaacccttaaaactccgtaacgaaccgaaccgtaccggtacccgttacttaacgttacctgtacggcgaaggtacgacgtacgttacgttacctagttaggttattaaggttgttcggtttaacgagttcgttcgtttcgttaagtttccggg

SEQ ID NO: 338564 - DNA, 549 bp, Homo sapiens
  misc_feature: GZ8MTXP01DEFKV.38.27.C05.1.454.CMB.2.raw
  modified_base (485)..(485): a, c, t, g, unknown or other
  misc_feature (485)..(485): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcccctggacaagggcctgagtggatgggatgcatcaacccagaactggcgaccacaaagtctgcaacagaagtttcagggcagggtcacatacgacccgagacacgtcatacaatacagacctactagaactacacgactaccctaaaactctacgacgaccgacggccgtactattactgtcgcgaagnggcagacgttactacgttaggttattagttggtcggtttcgagtgttctttgttaagtttcggg

SEQ ID NO: 338565 - DNA, 543 bp, Homo sapiens
  misc_feature: GZ8MTXP01CVC2A.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggaagctggggcctcagtgattgtcccctgccaggcttccggatatatcttcgacttctactattacactgggtgcgccaggtcccctggacaagggcctgagtggatgggatgcatcaaccccagaactggcgaccacaaagtctgcaacagaagtttcagggcagggtcacatcgacccgagacacgtcatacaatacagcctactagaactcgacactaccctaaaatctagacgacacggcctactattacctgtcgcgaagagcagagttaccgacgtttggttattaaggtgtcggttttcgagttgttacttttgaagttttcggg

SEQ ID NO: 338566 - DNA, 535 bp, Homo sapiens
  misc_feature: GZ8MTXP01EALHB.38.27.C05.1.454.CMB.2.raw
  modified_base (474)..(474): a, c, t, g, unknown or other
  misc_feature (474)..(474): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccaggtccctggacaagggcctgagtggatgggatgcatcaaccccagaactggcgacacaaagtctgcaacagaagtttcagggcagggtcacatgacccgagacacgtcatacaatacagcctacctgaactcacgctaccctaaaatctagacgacacggccgtactattactagtgcgaagnggcagagttccacttggttattaagtgtcggttttcgattgttcttttgttaagttttcgg

SEQ ID NO: 338567 - DNA, 555 bp, Homo sapiens
  misc_feature: GZ8MTXP01DFUMW.38.27.C05.1.454.CMB.2.raw
  modified_base (300)..(300): a, c, t, g, unknown or other
  misc_feature (300)..(300): n is a, c, g, or t
  modified_base (402)..(402): a, c, t, g, unknown or other
  misc_feature (402)..(402): n is a, c, g, or t
  modified_base (519)..(519): a, c, t, g, unknown or other
  misc_feature (519)..(519): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagcccaccctctcctgcagggccagtcagactattaggagcagctacttagcctggtaccagcaaaactggccaggctccaggctcctcatttangtgcgtccaccgagggccacgtggcatcccagaccagattcagtggcagtgcgtctgggcagtacttcactctcgtgactcgactaggactggaaccccaanagttacttttgcttgtagtattactgtacaactacttagtggtccttccggagtgtaacgttcggaccgaagggaccaaggggtcggaagttctaaagttcgtaaactggttacggnttacggcacctaatctgttccttcgaactttccccg

SEQ ID NO: 338568 - DNA, 526 bp, Homo sapiens
  misc_feature: GZ8MTXP01EM9RO.38.27.C05.1.454.CMB.2.raw
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatcaacccagaactggcgaccacaaagtctgcaacagaagtttcaggggcagggtcacatcgacccgagacacgtccatcaaatacagcctactgaactcagctacctaaaatctagacgacacggccgtactatactgtgcgaagaggcagagtcacttggttattaagtgtcggttttcgatgttctttgttgtttcgg

SEQ ID NO: 338569 - DNA, 652 bp, Homo sapiens
  misc_feature: GZ8MTXP01CILPO.38.27.C05.1.454.CMB.2.raw
  modified_base (330)..(330): a, c, t, g, unknown or other
  misc_feature (330)..(330): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggtcttccggatatatcttcgacttctactattacactgggtgcgccaggtccctggacagggcctgagtggatggatggcacncacccgagactggcacacaaagtctgacaacagtaagttcagggtcgacgggtcaccatacgacccgagacctacgacaatacaatacacgaccctacgtgaaacctcgaacaccttaacctaaattccgacgaacccgtaccgacccgggtaccgttacgtacttaaccgttggtacggaccgggaaggacgggacgtaaacggttaccgttaccccgttacggtttaagggttacgttaaagggtttcgggtttacccggttttttaacggaaggtttccggtttaacgttttttggaaccgggttttttaacccggggg

SEQ ID NO: 338570 - DNA, 607 bp, Homo sapiens
  misc_feature: GZ8MTXP01D6QS8.38.27.C05.1.454.CMB.2.raw
  modified_base (359)..(359): a, c, t, g, unknown or other
  misc_feature (359)..(359): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattcgtcccctgccaggcttccggatatatcttcgacttctactattacactgggtgcgccaggtcccctggacaagggcctggagtggatgggatgcatccaaccccagactggcaccacaaagtcngacaacagtaagtttcgagggcagggtcacgatacgacccgagaccacgtccatacaaactacgacgaccctactcgaactcacgacctacccttaaaatcctacgaccgaccgaccggtacctacttacttacctgtagccgaaggacggcgaagttacgttacccgtaagtttaggttagttaaggttcggtttacccggtttttcgacgtttcgttacgtttttggttaacgttttttcccgggg

SEQ ID NO: 338571 - DNA, 614 bp, Homo sapiens
  misc_feature: GZ8MTXP01B3O7B.38.27.C05.1.454.CMB.2.raw
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagtctggggcctcagtgattcgtcccctgccaggcttccggatatatcttcgacttctactattacactgggtgcgccaggtccctggacaagggcctgagtggatgggatgcatccaacccagaacnggacacacaaagtctgcaanagaagttcagggcagggtcacancgaccganacacgcatacgaactacacgcctaccgtagaacctacacgaccttaaccctaaaatccgtaacgaaccgaccgaaccggtccgttacttacttacgtcggtacgcggaagacgggactaacggttacgttacccgtaacggtttaggttaacgttaaaggttcggttcgggtttttaaccggtaagttcggttaccgtttttggttaacgtttttccgggg

SEQ ID NO: 338572 - DNA, 531 bp, Homo sapiens
  misc_feature: GZ8MTXP01EGGM6.38.27.C05.1.454.CMB.2.raw
  modified_base (473)..(473): a, c, t, g, unknown or other
  misc_feature (473)..(473): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatcaaccccagaactggcgaccacaaagtctgcaacagaagtttcagggcagggtcaccatcgacccgagacacgtcatcaatacagcctactgaactcacgctaccctaaatctagacgacacggcctactattactgtgcgaagngcagttagttccacttggttattaaggtgtcggtttgattgttcttttgttgtttcgg

SEQ ID NO: 338573 - DNA, 535 bp, Homo sapiens
  misc_feature: GZ8MTXP01ALKFR.38.27.C05.1.454.CMB.2.raw
  modified_base (421)..(421): a, c, t, g, unknown or other
  misc_feature (421)..(421): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (527)..(527): a, c, t, g, unknown or other
  misc_feature (527)..(527): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggttggcgtgaggagcctggggcctcagtgattgtcccctgccaggcttccggatatatcttcgacttctactattacactgggtgcgccaggtcccctggacaagggcctgagtggatgggatgcatcaaccccagaactggcgaccacaaagtctgcaacagaagtttcaggggcaggggtcaccatcgacccgagacacgtccatcaatacagcctaccngaactcacgctaccctaaatcctgaccgcacggccgtactattactgtgcgaagnggcagngtcctacgttggttattaaggtgtcgggttttcgattgcttttgntttccggg

SEQ ID NO: 338574 - DNA, 547 bp, Homo sapiens
  misc_feature: GZ8MTXP01DIVSS.38.27.C05.1.454.CMB.2.raw
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
  modified_base (436)..(436): a, c, t, g, unknown or other
  misc_feature (436)..(436): n is a, c, g, or t
  modified_base (538)..(538): a, c, t, g, unknown or other
  misc_feature (538)..(538): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggcttccggatatatcttcgacttctactattacactgggtncgccaggtccctggacaagggcctgagtggatgggatgcatcaaaccccagaactggacgaacacaaaagtcctagacaacaagtaacgtttcgaagggcaggggtcaccgatcgacccgagacacgtcaatacaaatacacgcctacngaactcacgctaccctaaaatcctagacgacacggctactatactgtgcgaagagcagagttccattggttattacggtgtcgtttcgattgttctttgttntttaacggg

SEQ ID NO: 338575 - DNA, 521 bp, Homo sapiens
  misc_feature: GZ8MTXP01DW56P.38.27.C05.1.454.CMB.2.raw
  modified_base (418)..(418): a, c, t, g, unknown or other
  misc_feature (418)..(418): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
tcagtcgatcacgtcacgaccggtgctcgatttagacgcgatcgaagggtttgggggagagcatcacccagcaaccacatctttcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatagcatcaacccagaactggcgacacaaagtctgcacaagaagtttcagggcagggtcaccatgacccgagacacgtcatcaatacagcctacngaactcagctaccgtaaatctagacacacggctctattactgtgcgagaagcagagttccagttgttagttagttgtggtttacgtntgtnttgtgttcgtgg

SEQ ID NO: 338576 - DNA, 534 bp, Homo sapiens
  misc_feature: GZ8MTXP01BB6VH.38.27.C05.1.454.CMB.2.raw
  modified_base (286)..(286): a, c, t, g, unknown or other
  misc_feature (286)..(286): n is a, c, g, or t
  modified_base (473)..(473): a, c, t, g, unknown or other
  misc_feature (473)..(473): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattgtcccctgccaggcttccggatatatcttcgacttctactattacactgggtncgccaggtccctggacaagggcctgagtgatgggatgcatcaaccccagaactgcgacacaaagtctgcaacagaagtttcagggcaggggtcacatcgacccgagacacgtccatcaaatacagccactagaactcagcctacctaaaatctagacgacaccggccgtctacttactgtgcgaagnggacagagtccagttggttattaaggtgtcggtttcgattggttcttttgttaagtttcgg

SEQ ID NO: 338577 - DNA, 631 bp, Homo sapiens
  misc_feature: GZ8MTXP01EMB7N.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtcccctgccaggcttccggatatatcttcgacttctactattacactgggtgcgccaggtcccctggacaagggcctgagtggagtgggatgcatccaaccccagaactggacgaccacaaagtctgacaaacagaagtttcgagggcagggtcacatcgacccgagacacgtcatacaaatacagaccctactacgaactacgacgacctaaccctaaaatccgtacgaaccgaaccgaccggtaccgttacttaactttaacctggttacgaccggaaggacggaccgtaacggttacgttaccccgtaacgtttacgggttaacgttaaagggttggttaccgggtttttccgtaagttggtttccgtttttaaggttaacgtttttccgggg

SEQ ID NO: 338578 - DNA, 641 bp, Homo sapiens
  misc_feature: GZ8MTXP01AKKDA.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtcccctgccaggcttccggatatatcttcgacttctacttattacactgggtgcgccaggtcccctggacgaagggcctgagtggagtgggatgcatccaacccagaactggacacacaagtctgcaacagtaagttcgagggcacgggtcacatcgacccgagacacgtccatacaaatacacgcctaccgacggaaactcgacaccttaaccctaaaatccgtacgaaccgaaccgaccgggtcccgttacttacgttaacgtcggtacggccggtaacggagggaccgtaaggttaccggtttaccccgtaacggtttacgggttaacgttaaacggggttgggtttaccgggtttttccgtaacggttgtttaccggtttttgttaacggtttttccggggg

SEQ ID NO: 338579 - DNA, 554 bp, Homo sapiens
  misc_feature: GZ8MTXP01AX3R5.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggcctcagtgattcgtcccctgccaggcttcggatatatcttcgacttctactattacactgggtncgccaggtccctggacaaggcctgagtggatgggatgcatcaaccccagaactggcgaccacaaagtctgcaacagaagtttcagggcagggtcaccatcgacccgagacacgtccaatcaatacagcctacctagaactcagcctaccctaaaatcctacgaacgacacggccgtactattctagtcgcggaagaggcagacgttcctacgttaggttattaaggttgtcgggttttcgagttgttcgttttgttaagttttccggg

SEQ ID NO: 338580 - DNA, 566 bp, Homo sapiens
  misc_feature: GZ8MTXP01BHUMR.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggcttccggatatatcttcgacttctatattacatgggtncgccacggtccctggacaagggcctggagtggatgggatgcatcaaaccccagaactggacaaccaacaaagtctagacaaacgaagtaagtttcgaaggggcacggggtccacgatcgaccgagacacgtcatacaatacatacccactagaacctacactacctaacctaaatcctacgaccacgaccgtcgtactactacgtgtcgacgaagagcagttacgttccagttggattagtggttcggtttgagttgttacttttgttaacgtttcgggg

SEQ ID NO: 338581 - DNA, 585 bp, Homo sapiens
  misc_feature: GZ8MTXP01D9X3Z.38.27.C05.1.454.CMB.2.raw
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttcggatatatcttcgacttctactattacacgtgggtgcgccaggtccctggacaagggcctgagtggagtgggatgacactaccaaaccccagaaacgtggaccgaaccaacaaagtctagacaaacaagtaagttcgaagggcagggtccacagtacgacccgagacacgtaccatacaaatacacgcctacgtacgaactcacgactaacctaaatcacgacacgcgaccgtactattactgtcgcgaagngntagttacgttaccgtagtttaggttaattaaggttggttacggtttcgtagttcgttcgttttgttaacgtttcgggg

SEQ ID NO: 338582 - DNA, 544 bp, Homo sapiens
  misc_feature: GZ8MTXP01D0CUM.38.27.C05.1.454.CMB.2.raw
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggctttggcgtgaggaagccgtggggcctcagtgattcgtccctgccaggcttccggatatatcttcgacttctactattacactgggtncgccaggtccctggacaagggcctgagtggatgggatgcatcaaccccagaactggaccgacaanaaagtctagacacaagaagtttcgagggcaggggtcacatcgaccgagacacgtaccatacaatacacgacctacctagaactcacggactaccctaaatctagacgacgacggaccgtctattactgtgaacgagagcagacgttcacgttgttaataaggtgtcggtttcgattcgtcgtttgttaacg

SEQ ID NO: 338583 - DNA, 535 bp, Homo sapiens
  misc_feature: GZ8MTXP01AZB5M.38.27.C05.1.454.CMB.2.raw
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccaggtcccctggacaagggcctgagtggatgggatgcatcaaccccagaactggcacacaaagtctgcaacagaagttcagggcagggtcacatcgacccgagacacgtcatcaatacagcctacctagaactcacgctaccctaaatctagacacacggccgtactattactgtcgcgaagagcagacgttccacgttggttattaaggtggtacggtttcgattgttcttttgaagttttccggg

SEQ ID NO: 338584 - DNA, 595 bp, Homo sapiens
  misc_feature: GZ8MTXP01EWS54.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagccgtggggcctcagtgattcgtcccctgccaggcttccggatatatcttcgacttctactattacacgtgggtgcgccaggtcccctggacaagggcctgagtggatgggatgcactaccaaccccagaacctggacaaccacaaagtctgcaaacagtaagtttcgagggcagggtcacgatcgaccgagacacgtcatacaaatacacgccctacgtacgaactacacgtacctaaccctaaatcctacgaccgtaccgaccggtccgtacttacttacgtgtcgcggaagacggacgacgttacgttcctaacgttaggttattaacggttggttcggttttcgtagttcggttcttttaagttaacgttttccgggg

SEQ ID NO: 338585 - DNA, 553 bp, Homo sapiens
  misc_feature: GZ8MTXP01DCVVZ.38.27.C05.1.454.CMB.2.raw
  modified_base (298)..(298): a, c, t, g, unknown or other
  misc_feature (298)..(298): n is a, c, g, or t
  modified_base (394)..(394): a, c, t, g, unknown or other
  misc_feature (394)..(394): n is a, c, g, or t
  modified_base (443)..(443): a, c, t, g, unknown or other
  misc_feature (443)..(443): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaactggccaggctccagctcctcatttanggtgcgtccaccagggccacgtggcatcccagacagattcagtggcagtgcgtctgggcagacttcactctcgtgatcgacagactggacccaaanagtattttgcttgtagtattactgtacaactacttatgggtcttccggngtgaccgttcggaccgtaagggaccaagggtggaaagttcgaaagttcgtaaacgtggttacgggcttacggccaaccgtaattcgtcggttctttccgaactttccccg

SEQ ID NO: 338586 - DNA, 549 bp, Homo sapiens
  misc_feature: GZ8MTXP01DRM0S.38.27.C05.1.454.CMB.2.raw
  modified_base (288)..(288): a, c, t, g, unknown or other
  misc_feature (288)..(288): n is a, c, g, or t
  modified_base (499)..(499): a, c, t, g, unknown or other
  misc_feature (499)..(499): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctgggggcctcagtgattgtcccctgccaggcttccggatatatcttcgacttctactattacactgggtncgccaggtccctggacaagggcctgagtggatggggatgcatcaaccccagaactggcgacacaaagtctgcaacagaagtttcaggggcagggtcacatcgacccgagacacgtcatcaaatacagcctactaggaactcacgactaccctaaatctacgacgacaccggccgttactattactgtgcgaagagggcagttacgttcccngttaggttattaaggtgtcggttttcgatgttcttttgaagttttccggg

SEQ ID NO: 338587 - DNA, 550 bp, Homo sapiens
  misc_feature: GZ8MTXP01DL2Y0.38.27.C05.1.454.CMB.2.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (486)..(486): a, c, t, g, unknown or other
  misc_feature (486)..(486): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggcttccggatatatcttcgacttctactattacactgggtncgccaggtcccctggacaagggcctgagtggatgggatgcatcaaccccagaactggacgaccacaaagtctgcaacagaagttcagggcagggtcacatcgacccgagacacgtcatacaaatacacgccctacctggaaacctcacgacctaaccctaaaatctagacgacgacggcgtactattactgtgcggaagnggcagacgttccattagggttattaaggtgtcggtttcgattgttcttttgttaagttttcggg

SEQ ID NO: 338588 - DNA, 603 bp, Homo sapiens
  misc_feature: GZ8MTXP01BWUZG.38.27.C05.1.454.CMB.2.raw
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcgagtgattcgtcccctgccaggcttccggatatatcttcgacttctactattacacgtggtgcgcaggtccctggacaagggcctgagtggagtggatgcatcaacccagactggcacacaaagtctagcaacaagaagtttcgagggacacgggtcacagtacgacccgagacacgtccanacaactacacgacctacgtagaacctacgacgaccgtaccctaaatccgtacgaaccgaccgacggtcctacttacttaccgtggtcgaccggaaggacggcgtaacggttacgttaccgtacgttagggttaagttaaggttcggttacgggttttaacagtttggttacgttttcggttaacgttttccgggg

SEQ ID NO: 338589 - DNA, 631 bp, Homo sapiens
  misc_feature: GZ8MTXP01CGB5M.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgtacttctactattacagtggtgcgccaggtccctggacagggcctgagtggagtggatgcatccaaaccccagaaccgtggacgaacccacaaagtctagacaaacagtaacgtttcgagggcagggtccacgagtacgacccgagaccacgtaccaatacaaactacacgaccctaacgtacggaaacctcaaccgtacctaaacccctaaaatccgaacgaccgtaaccgaccggccgttacctagttaccgtgtccgacggaagaggaccgagttacgttacccgtagttaggttaacgttaggttgttaccgggttttaacgagtttggttaccgtttttaagttcgtttttaaccgggg

SEQ ID NO: 338590 - DNA, 541 bp, Homo sapiens
  misc_feature: GZ8MTXP01DMB9R.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatcaaccccagaactggcgaccacaaagtctgcaacagaagtttcagggcagggtcaccatcgacccgagacacgtccatacaatacacgcctacctaggaactacacgctaccctaaaatctacgacacaccgccgtactattactgtgcgaagaggcagagttccacttggttattaaggtgtacggtttgactgttctttgttaagtttcgg

SEQ ID NO: 338591 - DNA, 612 bp, Homo sapiens
  misc_feature: GZ8MTXP01EUSO3.38.27.C05.1.454.CMB.2.raw
  modified_base (319)..(319): a, c, t, g, unknown or other
  misc_feature (319)..(319): n is a, c, g, or t
  modified_base (386)..(386): a, c, t, g, unknown or other
  misc_feature (386)..(386): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcccctggacaagggcctgagtggntggggatgcatcaaccccagaactggcgacacaaagtctgcaacagaagttcagggcagggtcacangaccgagacacgtccatacaaacacacgacctacctacggaactacacgaccgacccttaaaactacctacgaacgaaccgaaccggacccggtactaacttaacctacgtggccggaaggaagggacgaaggttacggttaacccgttaacgtttaacgggttagttaacgggtttacggtaacggttttcggttacgttttaggtaacgtttttcggttaaggg

SEQ ID NO: 338592 - DNA, 547 bp, Homo sapiens
  misc_feature: GZ8MTXP01EBFXW.38.27.C05.1.454.CMB.2.raw
  modified_base (478)..(478): a, c, t, g, unknown or other
  misc_feature (478)..(478): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtccccttcaggcttccggatatatcttcgacttctactatttacactgggtgcgccaggtccctggacaagggcctgagtgggatgggatgcatcaacccagaactggcgacaccaaagtctagcacaaagaagtttcagggcaggggtcaccgatgacccgagacacgtcatcaatacagcctactaggaacacagactaccctaaaatctagacgacacggccgtactattaactgtgcgngaagcagacgttcgacgttgttattaggttgtcggttttcgaattggtactttgtcgtttgtaacgggg

SEQ ID NO: 338593 - DNA, 545 bp, Homo sapiens
  misc_feature: GZ8MTXP01CNO7P.38.27.C05.1.454.CMB.2.raw
  modified_base (286)..(286): a, c, t, g, unknown or other
  misc_feature (286)..(286): n is a, c, g, or t
  modified_base (486)..(486): a, c, t, g, unknown or other
  misc_feature (486)..(486): n is a, c, g, or t
  modified_base (515)..(515): a, c, t, g, unknown or other
  misc_feature (515)..(515): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgcaggtccctggacagggcctgagtggatgggatggcatccaaccccagaactggcgacacaaagtctgcaacagaagtttcgagggcagggtcacatcgacccgagaccacgtccatcaaatacagcctacctgaaacctcacgcctaccctaaaatcctagaccgaacaccggccgtactatacgtgtcgcgaaggngcaggacgttccagttcggttattaggtntcggtttcgattgttcttttgcgtttcggg

SEQ ID NO: 338594 - DNA, 526 bp, Homo sapiens
  misc_feature: GZ8MTXP01BLQZU.38.27.C05.1.454.CMB.2.raw
  modified_base (476)..(476): a, c, t, g, unknown or other
  misc_feature (476)..(476): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatcaaccccagaactggcacacaaagtctgcaacagaagtttcagggcaggggtcaccatcgacccgagacacgtccatcaatacagcctactgaactacacgctaccctaaaatctagacgacacgggcctactattactgtgcgaagngcagagtcacttgttattagtgtcggtttcgatgttctttgttgtttcgg

SEQ ID NO: 338595 - DNA, 599 bp, Homo sapiens
  misc_feature: GZ8MTXP01C94S1.38.27.C05.1.454.CMB.2.raw
  modified_base (402)..(402): a, c, t, g, unknown or other
  misc_feature (402)..(402): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggagccgtggggcctcagtgattcgtcccctgccaggcttccggatatatcttcgacttctacttattacacgtgggtgcgccaggtccctggacagggcctgagtggatgggatgcatccaaaccccagaactggacgaaccacaaagtctagacaaacaagtaacgtttcgaggggcaggggtcacancgacccgagaccacgtcaatacaaatacacgtaccctaccgtacgaactacacgtacctaaccctaaaatcctacgaccgacgaccggtccgtactacttacgtgtcggcgaagacggctagacgttaccgtacgttagggttattaaggttcggttacggttttcgagttgttacgttttgttaagttttccgggg

SEQ ID NO: 338596 - DNA, 534 bp, Homo sapiens
  misc_feature: GZ8MTXP01EFEQW.38.27.C05.1.454.CMB.2.raw
  modified_base (285)..(285): a, c, t, g, unknown or other
  misc_feature (285)..(285): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (526)..(526): a, c, t, g, unknown or other
  misc_feature (526)..(526): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttcggatatatcttcgacttctactattacactgggtncgccaggtccctggacaagggcctgagtggatgggatgcatcaaccccagaactggcgacacaaagtctgcaacagtaagttcgagggcagggtcacgatcgaccgagacacgtccatacaatacacgcctacctggaacctcacgcctaccctaaaatctacgaccgacgacggtccgtactattacngtgcgaagngcagagttcacttggttattaggtgtcgtttgatgttctttgngtttcggg

SEQ ID NO: 338597 - DNA, 601 bp, Homo sapiens
  misc_feature: GZ8MTXP01DHGBJ.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcccctggacaagggcctgagtggatgggatgcatccaaccccagaactggcgaccacaaagtctgcaacagtaagttcgagggcagggtcacatcgacccgagaccacgtccatacaaatacacgaccctaccgtacggaacctcgacgtaccgttaacccctaaaattccgtacgaaccgaccaccgggccgttacttagttacctgtcgcgaaggacggcaggttacgttccgtacgtttagggttattaaaggttggttaccggttttcgtagttgttacgttttggttaacgttttccgggg

SEQ ID NO: 338598 - DNA, 594 bp, Homo sapiens
  misc_feature: GZ8MTXP01BDEHC.38.27.C05.1.454.CMB.2.raw
  modified_base (501)..(501): a, c, t, g, unknown or other
  misc_feature (501)..(501): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccaggtccctggacaagggcctgagtggatgggatgcatcaacccgagacgtgacgacacaaagtctgacaacaagtaagttcgaaggggcagggtccacatacgacccgagaccacgtaccataccaaatacgacgtcctaaccgagaacctcaacgccttaacctaaaagtcctacgaaccgacgaccggtcctacttacgttacctgcgngaagaggccaaggttcgttacccgtagttagggttaacttaaggtcggttacggttttcgaagtttccgttacttttaaggaacgttttcggg

SEQ ID NO: 338599 - DNA, 588 bp, Homo sapiens
  misc_feature: GZ8MTXP01AIQL6.38.27.C05.1.454.CMB.2.raw
  modified_base (226)..(226): a, c, t, g, unknown or other
  misc_feature (226)..(226): n is a, c, g, or t
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggccttccggatatatcttcgacttctactattacactgggtncgccaggtccctggacaagggcctgagtggatgggatgcataccaaccccagaactggacgaccaacaaagtctgacaaacgagtaagttcgaagggcagggtcaacagtcgacccgagacacgtccatacaatacacgacctaccgtacggaacctacacgaccgtacctaaaatcctacgaccgaccgaccggtccgtactactactgtcgcggaagacggcagttcgttccgtacgttaggttagttaacggttgttcgggttttcgtagttggttccttttgttaacgttttcgggg

SEQ ID NO: 338600 - DNA, 635 bp, Homo sapiens
  misc_feature: GZ8MTXP01D4EPR.38.27.C05.1.454.CMB.2.raw
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcgtgggctnagtgattgtccctgccaggtcttcggatatatcttcgacttctactatacactgggtncgccaggtccctggacaagggcctggagtggatgggatgcatccaacccngaactggacacacaaagtcngacaacagtaagttcaggggcaggggtcaccgatcgacccgagacacgtaccatcaaatacagaccctactacgaactcgacgaccttaaccctaaaagttcccagaacccgaacccgaccgggtacccgttacttaacgttaccgtaggttcgaccggtaaggtaacgggcgtaaacgggttactttaccccgtaacggttttaggttaaacgttaaagggtttgtttcgggggttttaactagtttggttccgttttttaaggttaacgtttttccggggg

SEQ ID NO: 338601 - DNA, 561 bp, Homo sapiens
  misc_feature: GZ8MTXP01EHNFB.38.27.C05.1.454.CMB.2.raw
  modified_base (288)..(288): a, c, t, g, unknown or other
  misc_feature (288)..(288): n is a, c, g, or t
  modified_base (526)..(526): a, c, t, g, unknown or other
  misc_feature (526)..(526): n is a, c, g, or t
  modified_base (541)..(541): a, c, t, g, unknown or other
  misc_feature (541)..(541): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttccggatatatcttcgacttctactattacactgggtncgccaggtcccctggacaagggcctgagtggatgggatgcatccaacccagaactggacgaccacaaagtctgcaaacagtaagtttcaggggcagggtcaaccgagtacgacccgagacacgtaccaatacaaatacacgcctaaccgtacgaacctacgacacctaaccctaaaactctacgaccgaacaccggcctacgtattacctgtgcgaagcgcagttagtccattagttnttaagtgtgtttcgnttgttctttgaagtttcggg

SEQ ID NO: 338602 - DNA, 616 bp, Homo sapiens
  misc_feature: GZ8MTXP01DNDKZ.38.27.C05.1.454.CMB.2.raw
  modified_base (226)..(226): a, c, t, g, unknown or other
  misc_feature (226)..(226): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctnagtgattgtcccctgccaggccttccggatatatcttcgacttctactattacactgggtgcgccaggtccctggacaagggcctgagtggatgggatgcatccaacccagaactggacaccgacaaagtctgacaaacgagtaagtttcgaagggaagggtacaccgatcgacccgagacacgtaccatacaatacacgtacctaccgtgaactcacgtaccctaacccgtaaaattcctacgaaccgaccaacccggtcctactacgttaactggtacgaccggagaaggcacgtacgttcccgtaagttagggttaagttaaacggttcggttcggggttttaccaagtttcgttacgttttaggtaacgttttcggtaaccggggg

SEQ ID NO: 338603 - DNA, 592 bp, Homo sapiens
  misc_feature: GZ8MTXP01ATOV0.38.27.C05.1.454.CMB.2.raw
  modified_base (227)..(227): a, c, t, g, unknown or other
  misc_feature (227)..(227): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattcgtccctgccaggcttccggatatatcttcgacttctactattacacgtgggtcgcgccaggtcccctggacgaagggcctgagtggatgggatgacactccaaccccagaactggacaccacaaagtcagacaaacagtaagttcgagggcagggtcacgatcgacccgagacacgtacatacaactacacgacctaccgtacgaactacacgtacctaacctaaatcctacgaccgacgacgtaccgtacttacttacgtgtcgcggaagacggacgtacgttacgttacctacgtttgggttaattaacggttcggttacggtttcgagttcgttcgttttcgttaagtttcggg

SEQ ID NO: 338604 - DNA, 516 bp, Homo sapiens
  misc_feature: GZ8MTXP01D12U6.38.27.C05.1.454.CMB.2.raw
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcccctggacaagggcctgagtgggatggggataggcatcaacccagaactggcgacacaaagctgcaacagaagttcagggcagggtcacatcgacccgagacacgtccataccaaatcacgtcctacaggaactcagcttaccctaaaatcagacgacncggctctattacntgcgaaggngnagngtcattgttnttagtgtgttgntnttnttgttgtg

SEQ ID NO: 338605 - DNA, 534 bp, Homo sapiens
  misc_feature: GZ8MTXP01BIU68.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggaagcctggggcctcagtgattgtcccctgccaggcttccggatatatcttcgacttctactattacactgggtgcgccaggtccctggacaagggcctgagtggatgggatgcatcaaccccagaactggcgaccacaaagtctgcaacagaagtttcagggcaggggtcaccatcgacccgagacacgtccatcaatacagcctacctgaactcagctaccctaaaatcctagacgacacggccgtctattactgtgcgaagaggcagagttccacgttggttattaaggtgtcggtttcgattgttctttgttgtttcgg

SEQ ID NO: 338606 - DNA, 568 bp, Homo sapiens
  misc_feature: GZ8MTXP01EG85C.38.27.C05.1.454.CMB.2.raw
  modified_base (313)..(313): a, c, t, g, unknown or other
  misc_feature (313)..(313): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccaggtcccctggacaagggcctgngtggatgggatgcatcaaccccagaactggcaaccacaaagtctgcaacagaagttcagggcagggtcaccatcgacccgagacacgtccatcaaactacagccctactcgaactcacgtcctaaccctaaatcctagacacgacggtcctactattacctgtgcgaagtacggcagttacgttcctaacgtttggttattaaggttggttacgggttttcgagttggttcctttttggttaacgttttccgggg

SEQ ID NO: 338607 - DNA, 548 bp, Homo sapiens
  misc_feature: GZ8MTXP01DM7SU.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcccctggacaagggcctgagtggatgggatgcatcaaccccagaactggacgacacaaagtctgcaacagaagttcgagggcagggtcacatcgaccgagacacgtccatcaatacagcctactgaactcacgctaccctaaatcctagaccgacacggtccgtactacttactgtcgcgaagaggcagacgttccacgttggttattaaggttgtacggttttcgattggttcttttgttaacgttttcggg

SEQ ID NO: 338608 - DNA, 621 bp, Homo sapiens
  misc_feature: GZ8MTXP01DZO6P.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggcttccggatatatcttcgacttctactattacactgggtgcgccaggtccctggacaagggcctgagtggatgggatgcatccaaccccagaactggacgaaccaacaaagtctgacaaacgaagtaagtttcgaggggcagggtccaacagtcgacccgagacacgtcatacaaatacagtcctacagaactacacgaccttaacccctaaaatccgtagaaccgaccgaccgggtacccttacgttaactttaccgtggtcgaccggtaaggacggcgtaagttacgttaccctaaggtttgggttaattaacgggttggttaccgggtttttcgagttcggttactttttggttaacgtttttccggggg

SEQ ID NO: 338609 - DNA, 584 bp, Homo sapiens
  misc_feature: GZ8MTXP01CSIW6.38.27.C05.1.454.CMB.2.raw
  modified_base (510)..(510): a, c, t, g, unknown or other
  misc_feature (510)..(510): n is a, c, g, or t
  modified_base (524)..(524): a, c, t, g, unknown or other
  misc_feature (524)..(524): n is a, c, g, or t
  modified_base (562)..(562): a, c, t, g, unknown or other
  misc_feature (562)..(562): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgactttctacttattacacgtgggtcgcgccgacggtcccctggaccgaacggggcctggagtggagtggggatgctatccaaaccccagaacgtggacgaacccaacaaagtcgtagaccaaacaaggtaacgtttcgaaggggcaaggggtccaaccatcgacccgagaccacgtccaatacaaataccagaccctacgtacgaactcacgtacctacctaaatcacgacacgccgctactntactgtcgcgaagngcagcgttcgagttaggttattacgttggtcggtttcngtgttctttgttaagtttcggg

SEQ ID NO: 338610 - DNA, 584 bp, Homo sapiens
  misc_feature: GZ8MTXP01C4FAV.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattcgtcccctgccaggcttccggatatatcttcgacttctactattacactgggtgcgccaggtcccctggacaagggcctgagtggatgggatgcatccaaccccagaactggacgaccaacaaagtctgacaaacagtaagtttcgaggggacaggggtccaacgatacgacccgagaccacgtccaatacaaatacagaccctaccgtagaacctacacgacttaacccctaaatcctacgaaccgaccgaccggccgtactacttactgtcgcgaagaggctaagacgttaccctagttggttattaaggttgtacgttttcgattgttcgttttgttaagtttcggg

SEQ ID NO: 338611 - DNA, 610 bp, Homo sapiens
  misc_feature: GZ8MTXP01AKHDP.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattcgtcccctgccaggcttccggatatatcttcgacttctactattacacgtgggtgccgccgacggtcccctggacaacgggcctgagtggagtgggatggcataccaacccagaacgtggaccgaacaacgaaagtctagacaaacgagtaagtttcgaggggtcgaacggggtccaacgagtacggacccgagaccacgtacatacaatacacgacctactagaactcacgacctacctaaatctacgacgacgacgctctactcgtgtcgcgaagacgacgagttacgttaccgtacgttaggttagttaacggttgggtacccggttttaacgtaagttcggtttacggtttttaagttaacgtttttccggggg

SEQ ID NO: 338612 - DNA, 628 bp, Homo sapiens
  misc_feature: GZ8MTXP01BWB59.38.27.C05.1.454.CMB.2.raw
  modified_base (227)..(227): a, c, t, g, unknown or other
  misc_feature (227)..(227): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattgtcccctgccaggccttcggatatatcttcgacttctactattacactgggtgcgccaggtcccctggacaagggcctgagtggagtgggatgcatccaacccagaactggacaccacaaagtctgacaaacagtaagtttcgaggggcacgggtacaccgagtacgacccgagaccacgtaccaatacaaactacacgtaccctaaccgtacggaactacgacgaccttaacccgtaaaacttccgtaacgaccgaaccgaccggtacctacgttacttaccgtgtcggcgtaaggacggacgtaacgttacgttacccgtagttacggttaagttaaggttcggttacggttttcgtagttcggttcttttaacggttcgttttaaccgggg

SEQ ID NO: 338613 - DNA, 575 bp, Homo sapiens
  misc_feature: GZ8MTXP01CAVQA.38.27.C05.1.454.CMB.2.raw
  modified_base (295)..(295): a, c, t, g, unknown or other
  misc_feature (295)..(295): n is a, c, g, or t
  modified_base (403)..(403): a, c, t, g, unknown or other
  misc_feature (403)..(403): n is a, c, g, or t
  modified_base (539)..(539): a, c, t, g, unknown or other
  misc_feature (539)..(539): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgctccaggggagagagccaccctctcctgcagggccagtcagactataggagcagctacttagcctggtaccagacaaaacctggccaggctcccaggcctcctntatttatggtgccgtccaccgacgggcccacgtggccactcccagacagattcagtggcagtgcgtctgggcagtacttcactctcgtgatcgacagactggacccanagtatttgctgtgttattactcgtacaactacgttagttcgggtaccttccgggtcgttcgtaccggttccgggtaccgaaggggtaccgaagggtcgggaagttcgtaaacgttcggtaaacgtggttcggttcncgtcacctaagttctcggttcttcgaacgtttcccg

SEQ ID NO: 338614 - DNA, 554 bp, Homo sapiens
  misc_feature: GZ8MTXP01EIBK9.38.27.C05.1.454.CMB.2.raw
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
  modified_base (499)..(499): a, c, t, g, unknown or other
  misc_feature (499)..(499): n is a, c, g, or t
tcagtcgatcacgtcacgaccggtgctcgatttagacgcgatcgaagggtttgggggagagcatcacccagcaaccacatctgtcctctagagaatcccctgagagcctccgttcctcaccatggactggacctggaggatcgtcttcttggtggcagcagtcaaaggagcccactcccaggtgaaagttggtccagtctgggtttggcgtgaggagcctggggcctcagtgattgtcccctgccaggcttccggatatatcttcgacttctactattacactggtncgccaggtccctggacaagggcctgagtggatgggatggcntcaaccccagaactggcgaccacaaagtctgacaacagtaacgtttcgagggaccacggggtcaaccgatcgacccgagacacgtcatacaatacagaccctactaggaacttacacgtctacctaaaatctacgacgacacggtccgtactatacgtgtcgcgaagacgnagttacgtcacgttggttattacgtgtcggtttgacttgttctttgttgtttcgg

SEQ ID NO: 338615 - DNA, 649 bp, Homo sapiens
  misc_feature: GZ8MTXP01CG2YF.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagttattgtcccctgccaggcttccggatatatcttcgacttctactatttacactgggtgcgccaggtcccctggacaagggcctgagtggagtgggatgcatcaacccagaactggcgacaaccaaagtctgacacaaagtaagtttcgagggcgaggggtcaaccgactacgacccgagaccgacgtccatacaaactacacgccctaccgacggactacacgaccttaacccttaaaactctacgaccgaaccgtacccggccgttacttacgttacgtgtacgacggaggaacggtacgaggtaccgttccgtaacggtttagggttaaacgttaacgggttcgggttaaccgggtttttaccgtaagtttcgggttaccgtttttagggtaacgtttttccgggttaaccgggggg

SEQ ID NO: 338616 - DNA, 569 bp, Homo sapiens
  misc_feature: GZ8MTXP01C7CSL.38.27.C05.1.454.CMB.2.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggtcttccggatatatcttcgacttctactattacacgtgggtncgccaggtcccctggacaagggcctgagtggagtgggatgcatccaaccccagaactggacaccacaaagtctgcaacagtaagttcaggggcagggcacatcgaccgagaccacgtcatacaatacactcctacctgaacctcacgtacctaccctaaatcctagaccgaccgacggccgttactacgttactgtgcggaagtagctagttacgttacctacgttaggttattaggttggtcggtttcgagttcgttcgttttaagttgttttccgggg

SEQ ID NO: 338617 - DNA, 548 bp, Homo sapiens
  misc_feature: GZ8MTXP01B3XO1.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggctttggcgtgaggaagccgtggggcctcagtgattcgtcccctgccaggcttccggatatatcttcgacttctactatttacactgggtgcgccaggtccctggacgaagggcctgagtggatggggatgcataccaaccccagaactggaccacacgaaagtctagacaacaagtaaagtttcgagggcagggtcacatcgaccgagacacgtaccatacaatacacgcctactacgactcacggctaaccctaaactctacgaacgacgaccgccgtctattactgtgaacgagagcagtacttccagttggttataagtgtcgtttcgattgtcgtttgttaacg

SEQ ID NO: 338618 - DNA, 596 bp, Homo sapiens
  misc_feature: GZ8MTXP01EWJIX.38.27.C05.1.454.CMB.2.raw
  modified_base (287)..(287): a, c, t, g, unknown or other
  misc_feature (287)..(287): n is a, c, g, or t
  modified_base (530)..(530): a, c, t, g, unknown or other
  misc_feature (530)..(530): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcgtgggcctcagtgattcgtcccctgccaggtcttccggatatatcttcgacttctactattacacgtgggtncgccgaggtcccctggacgaagggcctggagtggagtgggatgcatccaaccccgagaacgtggacaaccaacgaaagtcgagaccaaacgaagtaacgtttcgaaggggcagggtccaccgagtccgacccgagaccgacgtaccgtacaaactacgacgtacctaccgtagacctcgactacctaacctaaactcgtacgaccgacgaccgtccttactatacgtggtcgcggagaacggnagtcgttacacgttaggttagttaggttcgtggtttcgtgttagttcgtttgtcgtttggaacggg

SEQ ID NO: 338619 - DNA, 598 bp, Homo sapiens
  misc_feature: GZ8MTXP01B62LW.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgcaggtccctggacaaggctgagtggatggatgcatcaaccccagaacgtggacgaccacaaagtctagacaactaaggaacgtttcgaaggggcgacggggtcaccgatacgaccccgagacacgtcaatacaaactacacgtaccctaccgtacgaacctacgacgtaccgtaacccttaaaactccgtacgaacccgtaccgacccggccgttactatttaccgtgtacgcgtaagcggacgacgttacgttacctacgttggttattacggtgttcgggtttctagtgttctttgttcgtttcggg

SEQ ID NO: 338620 - DNA, 665 bp, Homo sapiens
  misc_feature: GZ8MTXP01CELEK.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtccctgccaggcttccggatatatcttcgacttctactattacactggtgcgccaggtccctggacaagggcctgagtggatgggatgcataccaaaccccagaacgtggacgaacccaacaaagtctagacaaacagtaagtttcgaaggggcgacgggtccaaccgagtaccggaaccccgagaaccgaccgtaccaattaacaaactaccgacgtacccttaaccgacggtaaacctcgaacgtacccttaaacccttaaaatccgtacggaaccgtaacccgaccgggtacccgttacttacgttaactcggtacgacggtaaggacgcgtaagttacgttacccgtaagtttacggttaaagttaacgggttcggttaccggttttaagtattcggttaccgttttgttaacgttttccgggg

SEQ ID NO: 338621 - DNA, 576 bp, Homo sapiens
  misc_feature: GZ8MTXP01EY26L.38.27.C05.1.454.CMB.2.raw
  modified_base (547)..(547): a, c, t, g, unknown or other
  misc_feature (547)..(547): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctactattacactgggtgcgccaggtccctggacaagggcctgagtggatgggatgcatccaaccccagaactggacaaccacaaagtctgacaacagaagtttcgagggcagggtcacatcgacccgagaccacgtccatcaatacacgcctacctgaactcacgacctaccctaaatcctacgaccgaccgacggtccgtactacttccgtgtcgcgaaggtacggcaggttacgttcctaacgtttggttattaacggtggttcggttttaacgngttcgttcgttttgttaacgttttccggg

SEQ ID NO: 338622 - DNA, 565 bp, Homo sapiens
  misc_feature: GZ8MTXP01BR1OS.38.27.C05.1.454.CMB.2.raw
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggtcttccggatatatcttcgacttctactattacactgggtgcgccaggtcccctggacaagggcctgaggtggagtgggatggacagtccaaacccccgagaaacgtggacgaaccaacaaagtctagcaaacagtaagttcaggggcaggggtcaccgatacgacccgagaccacgtcatacaaatacacgcctaacgtcgaactacacgcctacctaaaatcctagacgacgacggcgtctactacgtgtcgcgaagagcagcgtcctacgttgttattaggtgtcggtttcgattgttctttgttgtttcggg

SEQ ID NO: 338623 - DNA, 635 bp, Homo sapiens
  misc_feature: GZ8MTXP01CU1L5.38.27.C05.1.454.CMB.2.raw
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
  modified_base (402)..(402): a, c, t, g, unknown or other
  misc_feature (402)..(402): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattgtcccctgccaggcttccggatatatcttcgacttctactattacactgggtncgccaggtccctggacaagggcctggagtggatgggatgcactccaaaccccagaactggaccgaaccacaaagtctacgacaaacgagtaagtttcgagggcgagggtcacgancgacccgagaccacgtcaatacaataccacgaccctaccgtgaactacgacgtcctaaccctaaagtcctagaccgtaccgaccgggtccttacttagttacctaggtcggacggaaggacggactaacggttacgtttacccgtaggtttaacgggttagttaaacgggttgggtttacggtttttccggagtttcggttcgtttttaacggttaacggtttttcccggggg

SEQ ID NO: 338624 - DNA, 628 bp, Homo sapiens
  misc_feature: GZ8MTXP01D503M.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagccgtgggcctnagtgattcgtcccctgccgaggtcttccggatatatcttcgacttctactattacacgtgggtgccgtccacggtcccctggaccaaagggcctagaggtggatgggatgcatccaaccccagactggacacacaaagtctagcaaacagtaagtttcaaggggcaggggtccacgagtacgacccgagaccacgtaccatacaaatacgacgtaccctacgacgaacctcgacgtacccttaaacccgtaaaattcctacggaccgtaccgaaccggtcctacttacttaccgtgtacgcggaagcggactagttacggttaccctaacgtttacggttaattaacggttggttccggttttaacgtagttcggttaccgtttttgttaacgttttccgggg

SEQ ID NO: 338625 - DNA, 545 bp, Homo sapiens
  misc_feature: GZ8MTXP01ACVN8.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccaggtccctggacaagggcctgagtggatgggatgcatcaaccccagaactggcgaccacaaagtctgcaaacagaagtttcagggcaggggtcacatcgacccgagacacgtccatcaatacagacctacctggaacctcacgacctaccctaaaatctacgacgaccgacgccgtactacttactgtcgcgaagaggcagcgtaccacgttggttattaagtgtcggtttcgatgttctttgttaagtttcggg

SEQ ID NO: 338626 - DNA, 563 bp, Homo sapiens
  misc_feature: GZ8MTXP01DDUPA.38.27.C05.1.454.CMB.2.raw
  modified_base (386)..(386): a, c, t, g, unknown or other
  misc_feature (386)..(386): n is a, c, g, or t
  modified_base (484)..(484): a, c, t, g, unknown or other
  misc_feature (484)..(484): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggtcttccggatatatcttcgacttctactattacactgggtgcgccaggtccctggacaagggcctgagtggatgggatgcatcaaccccagaactggacacacaaagtctgcaacagtaagttcagggcagggtcacancgacccgagacacgtcatacaaatacagcctacctagaactacacgctaaccctaaaatctacgaccgacacggccgttactattactgtcgcgaagnggcagttacgttcctacgttaggttagttaaggttggtaccgggttttcgagttgttcgttttgttaacgttttcgggg

SEQ ID NO: 338627 - DNA, 530 bp, Homo sapiens
  misc_feature: GZ8MTXP01CXG7N.38.27.C05.1.454.CMB.2.raw
  modified_base (433)..(433): a, c, t, g, unknown or other
  misc_feature (433)..(433): n is a, c, g, or t
  modified_base (479)..(479): a, c, t, g, unknown or other
  misc_feature (479)..(479): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagctggggcctcagtgattgtcccctgccaggcttcggatatatcttcgacttctactattacactgggtgcgccaggtcccctggacaagggcctgagtggatgggatgcatcaaaccccagaactggacgaccacaaagtctgcaaacagaagtttcaggggcaggggtcaccatcgacccagacacgtccatcaaatacagcctactgaactcganactaccctaaaatctagacgacacggccgttactattactgtgcgngaggcagagtcacttggattagtgacggtttcgatgttctttgaatttcgg

SEQ ID NO: 338628 - DNA, 626 bp, Homo sapiens
  misc_feature: GZ8MTXP01DUZ9O.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagtaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctgggcctnagtgattgtcccctgccaggcttacggatatatattcgacttctactatttacactgggtgcgccaggtccctggacaaggcctgagtggatgggatgcatacaacccagaactggacgacaaccaaagtctagcaacaagtaagtttcgagggtcagggtacaccgatcgacccgagacacgtcatacaatacacgacctaccgtaggaacctcaacgtacctaacccgtaaaatccgtacgaaccgaccgtaccgggccgttacttaacgttaccgtgtacgaccggaaggaacggacgaggtacgttaccgtacgtttaggttaacgttaaggttcggttaacccgggttttcgtaagtttcggttaccgttttagtaacgttttcggtaaccggggg

SEQ ID NO: 338629 - DNA, 557 bp, Homo sapiens
  misc_feature: GZ8MTXP01D20PJ.38.27.C05.1.454.CMB.2.raw
  modified_base (222)..(222): a, c, t, g, unknown or other
  misc_feature (222)..(222): n is a, c, g, or t
  modified_base (283)..(283): a, c, t, g, unknown or other
  misc_feature (283)..(283): n is a, c, g, or t
  modified_base (452)..(452): a, c, t, g, unknown or other
  misc_feature (452)..(452): n is a, c, g, or t
  modified_base (496)..(496): a, c, t, g, unknown or other
  misc_feature (496)..(496): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggccagtctgggttgcgtgaggagcgtgggcctnagtgattgtcccctgccaggcttccggatatatcttcgacttctactattacacgtgggtncgccaggtcccctggacaagggcctgagtggatgggatgcatcaacccagaactggacgacacaaagtctagacaaacagtaagtttcaaggggcagggtcaccgatcgacccgagacacgtccatacaatacagccctactagaactcacgtacctaacccttaaaanctacgaacgtaccgacgggtcctactacttactgtcgcgaaggnggcaacggttagttcccaatttggattaagtggtcgtttgatgttcttttgaagtttcggg

SEQ ID NO: 338630 - DNA, 577 bp, Homo sapiens
  misc_feature: GZ8MTXP01CITVP.38.27.C05.1.454.CMB.2.raw
  modified_base (289)..(289): a, c, t, g, unknown or other
  misc_feature (289)..(289): n is a, c, g, or t
  modified_base (511)..(511): a, c, t, g, unknown or other
  misc_feature (511)..(511): n is a, c, g, or t
tcagtcgatcacgtcacgaccggtgctcgatttagacgcgatcgaagggtttgggggagaggcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattcgtcccctgccaggtcttcggatatatcttcgacttctactattacactgggtncgccaggtccctggacaagggcctgagtggatggatgcaactccaaaccccagaactggacgaacccaacaaagtctagcaaaccaaggtaacgtttcgaaggggcagggtccaccagtcgacccgagacacgtaccaatacaaataccacgcctacgtacgaaactcacgacctacctaaatctacgacgaccacggcctactattactgtgcgaagacgntagacgtccgtagttacggttattaacggtgtacggtttcgtattgttactttgttaagtttcggg

SEQ ID NO: 338631 - DNA, 624 bp, Homo sapiens
  misc_feature: GZ8MTXP01CPOWZ.38.27.C05.1.454.CMB.2.raw
  modified_base (228)..(228): a, c, t, g, unknown or other
  misc_feature (228)..(228): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagttattcgtcccctgccaggcttccggatatatcttcgacttctacttattacacgtgggtcgcgccaggtccctggacgaagggcctggagtggagtgggatgcataccaaccccagaactggacaacaacccaaagtctgacaacgaaagtaagtttcgaggggacaggggtacaccgatacgacccgagaccacgtaccatacaatacacgtacctaccgtacgaactcgacgtacctaaccctaaatccgtacgaaccgaccaccggtccttacttaacgttactggtcgacggaggaagacgagtacgttccgtacgttggttaacgttaaggttcggttaacggtttacgtgttccggttgtttacggttaacgtttcggtaacggggg

SEQ ID NO: 338632 - DNA, 636 bp, Homo sapiens
  misc_feature: GZ8MTXP01AMR5C.38.27.C05.1.454.CMB.2.raw
  modified_base (433)..(433): a, c, t, g, unknown or other
  misc_feature (433)..(433): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgacttctacttattacacgtgggtcgccgccgaggtcccctgggacaagggcctggagtggatgggatgcatccaacccagaactggacaccacaaagtctgcaaacagtaagttcgagggcagggtcacatcgaccgagacacgtccatcaaatcacgcctaccgngaactcaacgcctaaccctaaaagtcctacgaaccgaccgaccggtaccgttacttaacgttacgtcggttcggccggtaaggacgggaccctaaaggttccgtttacccgtaacggtttacgggttaaatttaacgggtttcggttacccgggtttttaacgagtttcggttaccgttttttggttaacgtttttcccgggg

SEQ ID NO: 338633 - DNA, 621 bp, Homo sapiens
  misc_feature: GZ8MTXP01DZIUX.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggagcctggggcctcagttatgtcccctgccaggcttccggatatatcttcgacttctactattacactgggtgcgccaggtcccctggacaagggcctgagtggatgggatgcatcaacccagaactggcgacacaaagtctgcacgaagtaagtttcgagggcagggtcaccatcgacccgagacacgtccagtcaatacacacctactaggaacctcgacgtacctaacccttaaaactccgtacgaaccgaaccgaccggtacccgttacttaactttaacgtggttacgtaccggaaggaacgggaacaggtacgtttaccgtaacgtttagggttaacgttaaggttcggttcgggtttttacgaacgtttgttccgtttttgtaacgttttcggttaacggggg

SEQ ID NO: 338634 - DNA, 715 bp, Homo sapiens
  misc_feature: GZ8MTXP01A8AGB.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtccctgccaggtcttccggatatatcttcgtacttctacttattacacgtgggtcgcgccgacggtcccctggaacgaagggcctgaggtggagtgggatgcactaccaaaccccagaaccgtggaccaaccaacgtaaacgtcgtagaccaaacgtaaggtaacgtttcgaaggggacgtacggggtaccaaccgagtaccggacccgagaaccaccgtacataacaactaccacgtaccctacgtacgaactacaacgtacctaaacccgtaaacttccgaacgaaccgaaccgtaccgggtcccttaacttacgttaaccgtcgtacggacggtaacggaccgggttacgtaaacgggttaccgttacccgttaacgggtttacgggttaagttaacgggtttcgggtttaccgggtttttaacgtacggtttgggttttaccgtttttaaggttaaccggtttttaaccggggg

SEQ ID NO: 338635 - DNA, 566 bp, Homo sapiens
  misc_feature: GZ8MTXP01DHIFF.38.27.C05.1.454.CMB.2.raw
  modified_base (223)..(223): a, c, t, g, unknown or other
  misc_feature (223)..(223): n is a, c, g, or t
  modified_base (494)..(494): a, c, t, g, unknown or other
  misc_feature (494)..(494): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagctgggcctnagtgattgtccctgccaggtcttcggatatatcttcgacttctacttattacacgtgggtgcgccaggtccctggacaagggcctgagtggatgggatgcatcaaccccagaactggacgaccacaaagtctgcaaacagtaagttcgagggcagggtccacatcgacccagaccacgtccatacaaatacagaccctacgtaggaacctcaacgtccttaacccctaaatcctagaaccgacaccggtcctactactactgtgcgaaggngactagacgttccgatttgggttattaaggttgtcggttttaacgagttgttcttttgttaagttttccggg

SEQ ID NO: 338636 - DNA, 610 bp, Homo sapiens
  misc_feature: GZ8MTXP01AELLC.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgcccctgccaggcttccggatatatcttcgacttctactattacactgggtgcgccaggtccctggacaagggcctgagtggatgggatgcatccaaccccagaactggacgaccaacaaagtctagacaaacaagtaacgtttcgaggggtcacggggtcacagtcgacccgagaccacgtacaatacaaatacacgacctaccgtacggaactacacgacctaaccctaaaatcctaacgaaccgaaccgaccggacccgttacttaacttaccgtgtcggcgaaggacggacgagttacgttacctaacgttggttattaaggttcgggttacggttttcggagttcgttcgttttgttaacgtttcgggg

SEQ ID NO: 338637 - DNA, 624 bp, Homo sapiens
  misc_feature: GZ8MTXP01DURLQ.38.27.C05.1.454.CMB.2.raw
  modified_base (226)..(226): a, c, t, g, unknown or other
  misc_feature (226)..(226): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcgtggggcctnagtgattcgtcccctgccaggtcttccggatatatcttcgacttctactattacacgtgggtgcgccacggtccctggacaagggcctgagtggatggatgcatccaaccccagaactggacgaaccaacaaagtctagaccaaacagtaaggtttcaggggacacgggtcacagtcgacccgagaccaccgcatacaaactacacgcctacctacgaactacacgtacctaaccctaaaactccgtaacgaccgaccgaccggtaccttacttacgttacgtggtcgacggaaggacggacgtaacggttacgttaccgtaagtttacgggttaagttacgggttggttacggttttcgtagttcgtttacgtttttggttaacgttttaaccgggg

SEQ ID NO: 338638 - DNA, 548 bp, Homo sapiens
  misc_feature: GZ8MTXP01CIDZC.38.27.C05.1.454.CMB.2.raw
  modified_base (223)..(223): a, c, t, g, unknown or other
  misc_feature (223)..(223): n is a, c, g, or t
  modified_base (399)..(399): a, c, t, g, unknown or other
  misc_feature (399)..(399): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagctgggcctnagtgattcgtccctgccaggcttcggatatatcttcgacttctactattacactgggtgcgccaggtccctggacaagggcctgagtggatgggatgcatcaacccagaactgcgaccacaaagtctgcaacagaagttcagggcaggggtcaccatcgacccgagacacgtccanacaatacagccactgaactcacgctacctaaaatctacgacgaccaccggccgtactacttactgtgcgaaggagcgagttacgttacctacgttagggttattaaggtgttacggttttcgagttgttcttttggttaagttttcggg

SEQ ID NO: 338639 - DNA, 603 bp, Homo sapiens
  misc_feature: GZ8MTXP01A1CPO.38.27.C05.1.454.CMB.2.raw
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (413)..(413): a, c, t, g, unknown or other
  misc_feature (413)..(413): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggagcctggggcctcagtgattgtccctgccaggcttccggatatatcttcgacttctactattacatgggtgcgccaggtccctggacaagggcctgagtggatgggatgcatccaacccagaacgtggacgaaccaacaaagtcngaccaaanagtaagtttcgagggcagggtcacagtacgacccgagaccacgtccanacaatacacgaccctacgacgaactacgacgtactaaccctaaaatccgtacgaaccgaccgaccggaccgttacttacgtacgttggtacgccggaaggacggttcacggttacgttccgtaacgtttgggttaattaagggttggtcggttttaacgagtttcgttacgttttgttaacgtttcgggg

SEQ ID NO: 338640 - DNA, 625 bp, Homo sapiens
  misc_feature: GZ8MTXP01CNHD0.38.27.C05.1.454.CMB.2.raw
  modified_base (537)..(537): a, c, t, g, unknown or other
  misc_feature (537)..(537): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagccgtggggcctcagtgattgtcccctgccaggtcttccggatatatcttcgacttctacttattacagtgggtgcgccaggtccctggacaggcctgagtgatgggatgcataccaacccagaactggacgaaccaactaaagtcgagacaaacgaagtaacggtttcgaagggggacgtacggggtaccaaccgtacgtaccggaaccccgtagaaccgacgttaccaattaccaaactaccgacgtaccctaacgtacgtaacctcacgtacctaaccccttaaatccgtagaaccgtacaccggtcgtacttagttacgngtagcgaaggcgactagttacgttaccgtgttaggttaagttacgttggttcggttttaagatttcgttcttttggttcgttttcggg

SEQ ID NO: 338641 - DNA, 535 bp, Homo sapiens
  misc_feature: GZ8MTXP01EKBN0.38.27.C05.1.454.CMB.2.raw
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggagcctggggcctcagtgattcgtcccctgccaggccttccggatatatcttcgacttctactattacactgggtgcgccaggtcccctggacaagggcctgagtggatgggatgcatcaacccagaactggcgacacaaagtctagcaaacagaacggtttcaaggggcaggggtccaaccgatacgacccgagacacgtccatacaatacagcctactagaactcagctacctaaaatctagacgacacgcgtactatacngtgcgaagagcagngtacattagttnttaagtgtcgttctagtgttctttgttaagtttgg

SEQ ID NO: 338642 - DNA, 716 bp, Homo sapiens
  misc_feature: GZ8MTXP01BZQ2H.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctgagtgattcgtcccctgccaggtcttccggatatatcttcgacttctactattacactgggtgcgccaggtccctggacaagggcctgagtggagtgggatgcactccaaaccccgagaacgtggaccgaaccaacgaaaggtctagaccaaacgaaggtaaggtttacgaaggggtccaacgggggtaccaaaccgtagtaccgaaccccgaagaaccgaaccggtacccaagttacaaaacttacgaacggtaccccttaaccgtacggaaaccttaccgaaacgtacccttaaaccccgttaaaactcccgtacggaaacccgaaccgacccggtcccgtttaccttaacgttaaccgtcggtacgacggaacggaacgggctaacggttacgttacccctaaggttttacggttaacgttaaggttcgggttacggttttaaccgtaagtttcggttaccgtttttaaggttaacgttttcgggg

SEQ ID NO: 338643 - DNA, 602 bp, Homo sapiens
  misc_feature: GZ8MTXP01DG4GC.38.27.C05.1.454.CMB.2.raw
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (406)..(406): a, c, t, g, unknown or other
  misc_feature (406)..(406): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtagaaattggtccagtcgtgggtttggcgtgaggaagctggggcctnagtgattcgtcccctgccaggcttccggatatatcttcgtacttctactatacacgtgggtncgccgaggtccctggacaagggcctgagtggatgggatgcatccaacccagaactggacacacaaagtcagacaaacagtaagttcgagggcgagggtcaccgatacgacccganacctacgacatacaactacacgtcctaacgacgaactcacgtactaacctaaaactcacgaaccgaccgacggtacctctaagttaccgtgcggagaacggtagaccgtaagaccggttacctaagtttaggttaattaagggttcgtttcgggttttaactaggtttcgttcgtttttgttaacgttttccgggg

SEQ ID NO: 338644 - DNA, 624 bp, Homo sapiens
  misc_feature: GZ8MTXP01BRY6U.38.27.C05.1.454.CMB.2.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccaccctctcctgcagggccagtcagactagttaggancagtctacttagcctggtaccagacaaaactgccaggctccgagctcctctatttagtggtcgccgtccaccgacgggcccacgtcggaccactccccgaagacagtacttcgaggtcggacaggtcgcgttacgtagggaacgtagtaccttcacgtcgtcgtagactcgacgagactacggaacccaagtagtattttgcttgtagttacttacgtgtacaactacgttagtcgggttccttcgggtcgtacggtaccggttccggaccgaaacgggacctaagggtaacggtaagttacgaacgttacggtaacgttggttcggcttacggaactaccgtaagttcgtacgttccttaaccgttaactttccccg

SEQ ID NO: 338645 - DNA, 538 bp, Homo sapiens
  misc_feature: GZ8MTXP01AV2VF.38.27.C05.1.454.CMB.2.raw
  modified_base (483)..(483): a, c, t, g, unknown or other
  misc_feature (483)..(483): n is a, c, g, or t
tcagtcgatcacgtcacgaccggtgctcgatttagacgcgatcgaagagtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaacccagactggccacacaaagtctgacacaagagttcgagggcagggtcacatcgaccgagacacgtccatacaatacacgcctactaggaactcacggtcctacctaaactctacgaccgacgaccggccgtactacttacgtgtgcgagnggcagtacgtccacgttggttataaggtgtcggtttcgattgtcgttttgtaacg

SEQ ID NO: 338646 - DNA, 608 bp, Homo sapiens
  misc_feature: GZ8MTXP01CFK29.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatccaaccccagaactggacgaaccacaaagtctgacaaacagtaagtttcgaggggcagggtccaacagtacgacccgagaccacgtaccatacaaatacacgccctacctacggaacctacacgacctaaccctaaaatccgtacgaccgaccgaccggtccgtactacgttactgtcgacggaaggacggcaaggttacgttaccgtacgtttagggttagttaaggttcgggttacggttttcgagtttcgttcgtttttggttaacgttttccgggg

SEQ ID NO: 338647 - DNA, 703 bp, Homo sapiens
  misc_feature: GZ8MTXP01DBT74.38.27.C05.1.454.CMB.2.raw
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttgcgtgaggagccgtggggcctcagttattcgtcccctgccaggcttccggatatatcttcgtacttctactatttacacgtgggtgcgcctaggtcccctggacaagggcctgagtggatgggatgcactaccaaccccgagaactgggcaacaaccaaagtctcgacacaagtaacgtttcgaaggggcgtaggggtaccaaccagtacggaaccccgagacctaccgtccaataccaaataaccgacgtaccctaaccgtacggtaaacctacgaacgtaccccttaaacccgttaaaactccgttaaacggaacccgtaaccgtacccgggtacccttacgtttaaacgtttaccgtggttacggacgggaacggtaacggaacgttaacgggtaccgttacccgtaaacgtttacgggttaagttaacgggttcggtttaacggttttcgtaagtttcgttcgtttttaggtaacgtttcgggtaaccggggg

SEQ ID NO: 338648 - DNA, 666 bp, Homo sapiens
  misc_feature: GZ8MTXP01DJIMK.38.27.C05.1.454.CMB.2.raw
  modified_base (230)..(230): a, c, t, g, unknown or other
  misc_feature (230)..(230): n is a, c, g, or t
  modified_base (496)..(496): a, c, t, g, unknown or other
  misc_feature (496)..(496): n is a, c, g, or t
tcagtcgatcacgtcacgaccggtgctcgatttagacgcgatcgaaggggtttggggggaggagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggagcgtggggcctnagtgattcgtccctgccaggtccttcggatatactcttcgacttctacttattacacgtgggtcgcgccgacggtccctggacgaagggccgtggaggtgggagtggggatggacaactaccaaaccccgagaaccgtcgggaccaaacccgaaccgtaaagtcgtaggaccaaaacgaaggtaacgtttacgaggggtaccgacggggtaccaccgagtacgacccgagaccacgtcatacaatacacgtaccctacgacgaacncaccgtacctaaccttaaactctacgaccgaccgaccggtccttacgtacgttacgtcggtcgcgggaagcggacgtaggttaccgttacccgtagtttagggttaacgttaggttcggtttacgggttttcgttacgttggtttacttttcggttaacgttttcggggg

SEQ ID NO: 338649 - DNA, 621 bp, Homo sapiens
  misc_feature: GZ8MTXP01EV0GP.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattcgtcccctgccaggtcttccggatatatcttcgacttctactattacactgggtncgccaggtccctggacaagggcctgagtggatgggatgcatcaacccagaactggcaccacaaagtctagcaaacagtaagtttcgagggcagggtcaccgatcgacccgagacacgtcatacaaatacacgaccctaccgtacggaacctcaacgtacctaacccttaaaatcctacgaaccgaccgaccggtcccgttacttacgttaaccgtgtcggaccggaaggacggacgacggttaaccgttccgtaacgtttagggttaacttaagggtttcggttacggttttcgtagttcggttaccgtttttaaggttaacgttttccgggg

SEQ ID NO: 338650 - DNA, 633 bp, Homo sapiens
  misc_feature: GZ8MTXP01AJGWG.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgccaggtccctggacaagggcctgagtggatgggatgcatcaaccccagaactggacgaccacaaagtctagacaacagtaagtttcgaggggacaggggtcacatacgacccgagacacgtaccatacaaatacacgtaccctaaccgtacggaaacctcgaacgtacccgttaaccccttaaaactcctacgaacccgaccgaaccggtcccgtacttaacttacgtcgtcggcgaaggacggcgtaacggttacgttaccccgtaacgtttacgggttaagttaaacggttcggttcggtttttaacgagtttggttccgtttttgttaacgttttccgggg

SEQ ID NO: 338651 - DNA, 571 bp, Homo sapiens
  misc_feature: GZ8MTXP01DTNY7.38.27.C05.1.454.CMB.2.raw
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
  modified_base (487)..(487): a, c, t, g, unknown or other
  misc_feature (487)..(487): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagccccactcccaggtgaaattggtccagtctgggtttggcgtgaggagccgtgggcctnagtgattgcccctgccaggcttccggatatatcttcgacttctacttatacacgtgggtncgcaggtccctggacaagggcctgagtggatgggatgcatccaacccngacngcgacacaagtcngcaacgagtaagttcgagggcagggtcacntcgaccgagacacgccatacaatacacgcccacgtacgaactcacgacctaaccctaaagtcctacgaccgacgaccggtcctactacttacgtgtcgcgaaggngacctagttacgttccctaagtttggttaacgttaggtggttcgttttaacgagttcgttacgttttaagttaacgttttcggg

SEQ ID NO: 338652 - DNA, 655 bp, Homo sapiens
  misc_feature: GZ8MTXP01B9CHE.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtgggcctcagtgattcgtcccctgccgaggtccttccggatatatcttcgacttctactattacactgggtgcgccaggtccctaggacaagggcctgagtggagtgggatgcactccaaaccccagaactggacgaaccaacaaagtctagacaaacgaagtaacgtttcgaaggggacgtaggggtaccaccgagtacgacccgagaccacgtaccaatacaaactacacgtaccctaccgtacggtaaacctacacgtacccgttaaaccctaaaagttccgtacgaaccgaccgaccggtccgttaacttactttacgtcgtacggccggtaaggacggcgtaacgttacgttccgtaacgtttaggttaagttaacggttcggttacgggttttcgtagtttcgttacgttttgttaacggttttcccgggg

SEQ ID NO: 338653 - DNA, 600 bp, Homo sapiens
  misc_feature: GZ8MTXP01BNFY7.38.27.C05.1.454.CMB.2.raw
  modified_base (291)..(291): a, c, t, g, unknown or other
  misc_feature (291)..(291): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagccccactcccaggtgaaattggtccagtctgggtttggcgtgaggaagcctggggcctcagtgattgtcccctgccaggtcttccggatatatcttcgacttctactattacacgtgggtncgccaggtccctggacaagggcctgagtggatgggatgcatccaaccccagaactggaccgaccacaaagtctgcaaacgagaagtttcagggcacggggtcacatcgacccgagaccacgtcatcaaactacacacctacctaggaactcacgccgttacccctaaaatccgtacgaccgaccgacggcccgttacttacttactggtcgtcggaaggcggacgtaggttacgttcctaacgtttggttaattaacggttgttcggttttaacgggatttcggttctttttaagaacgttttccgggg

SEQ ID NO: 338654 - DNA, 702 bp, Homo sapiens
  misc_feature: GZ8MTXP01BS0BW.38.27.C05.1.454.CMB.2.raw
  modified_base (168)..(168): a, c, t, g, unknown or other
  misc_feature (168)..(168): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggtttggcgtgaggagcctggggcctcagtgattcgtcccctgccaggcttccggatatatcttcgacttctactattacactgggtgcgcacggtccctggacagggcctgagtggagtggatgcatcaacccagaactggcacacaaagtctagcaaacaagtaacgtttcgagggtcacgggtcacgatacgacccgagaccacgtcactacaaacgtacacgtaccctaaccgtacggtaaacctaccgaacgtacccttaaaccccgttaaaattcccgtacggaaacccggaaccccgtaacccgggtacccgttaacccgttaaacgttaccgttacgggttacggacccgggaaagggtaaccgggacgtaaacggttaccggtttaaccccgtaaggttttacgggttaacgtttaaacgggttcggggtttacccgggttttttaaccggaagttttccggttacccgtttttgtttcgggttttaacccggg

SEQ ID NO: 338655 - DNA, 577 bp, Homo sapiens
  misc_feature: GZ8MTXP01AS7JR.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctacttattacactggtgcgccaggtccctggacaagggcctgagtggatgggatgcatccaacccagaactggacgacacaaagtctgcaacagtaagttcgagggcgaggtcacatcgaccgagacacgtcatacaatacacgacctaccgtagaactcacgacctaaccctaaatcctacgaccgaccgaccggtccgtacttacttacgtgtcgcggaagaggactagttacgttaccgtacgttaggttattaaggtcggttcggttttcgagttcgttacgttttgttaacgttttccgggg

SEQ ID NO: 338656 - DNA, 630 bp, Homo sapiens
  misc_feature: GZ8MTXP01ETXSU.38.27.C05.1.454.CMB.2.raw
  modified_base (168)..(168): a, c, t, g, unknown or other
  misc_feature (168)..(168): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggtttggcgtgaggagccgtggggcctcagtgattcgtcccctgccaggtccttccggatatatcttcgacttctactattacacgtgggtgcgccacggtccctggacaagggcctgagtggagtgggatgcataccaaccccagaacgtggaccaaccaacgaaagtctgaccaaacgaagtaacggtttcgaaggggcgacgggtaccaccgagtaccgacccgagacacgtacatacaaactacacgtacctacgtacgaactacacgtacctaacccttaaaatcgtacgaaccgaccgaccggtaccgttacttacgttacgtacgtacgcggaagacggacgtacgttacgttaccgtacgttaggttagttaacggttcggttacggtttcgtagttcgttacgtttgttaacgtttccgggg

SEQ ID NO: 338657 - DNA, 617 bp, Homo sapiens
  misc_feature: GZ8MTXP01EYOBV.38.27.C05.1.454.CMB.2.raw
  modified_base (226)..(226): a, c, t, g, unknown or other
  misc_feature (226)..(226): n is a, c, g, or t
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtgggcctnagtgattcgtccctgccagcttccggatatatcttcgacttctactattacacgtgggtcncgccaggtcccctggaacaagggcctgagtgagtgggatgcataccaacccgagaactggacgaaccaacaaagtctagacaaacgagtaacgtttcgagggcagggtccacgatacgaccgagacacgtcatacaatacacgcctaccgtcgaactacacgtaccgtaacctaaaacgtctacgaaccgaccgaccgtaccgtacttacgttacctgtcgacggaacgtacggctaagttacgttacccgtagtttacgggttattaaagggttcggtttacggttttaacgttacgttcgtttacgttttggttaacgttttccgggg

SEQ ID NO: 338658 - DNA, 582 bp, Homo sapiens
  misc_feature: GZ8MTXP01CSZ03.38.27.C05.1.454.CMB.2.raw
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
  modified_base (501)..(501): a, c, t, g, unknown or other
  misc_feature (501)..(501): n is a, c, g, or t
  modified_base (559)..(560): a, c, t, g, unknown or other
  misc_feature (559)..(560): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtccccttcaggcttccggatatatcttcgacttctactattacactgggtcncgccaggtcccctggacaagggcctggagtggagtgggatggcactacccaacccgagaacgtcggacgaacaaaccaaaggtctacgacaacaaagtaacgtttcgaggggcgacgggtaccacgagtacgacccgagaccacgtaccatacaatacacgtacctacgacgaactcacgaccctaactaaactctacgacacgacgtccgttntacttactgtacgcgaggaagcaggtacttccgtagttgttacgttagttgttcgttnnttgttctttgtgttcggtcggg

SEQ ID NO: 338659 - DNA, 577 bp, Homo sapiens
  misc_feature: GZ8MTXP01BXLIO.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctactattacactgggtgcgccaggtcccctggacaagggcctgagtggatgggatgcatccaaccccagaactggcaaccacaaagtctgcaaacaagtaagttcgaggggcaggggtcaccagtcgacccgagaccacgcatacaaatacacgtcctacgtacgaactacgacgactaccctaaatcctacgaccgacgaccggccttactattacgtgtcgcgtaaggacggcgacgttacgttcctacgttaggttattaaggttggtcggttttcgagttgttcgttttgttaagttttcggg

SEQ ID NO: 338660 - DNA, 606 bp, Homo sapiens
  misc_feature: GZ8MTXP01A1WQ0.38.27.C05.1.454.CMB.2.raw
  modified_base (287)..(287): a, c, t, g, unknown or other
  misc_feature (287)..(287): n is a, c, g, or t
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
  modified_base (580)..(580): a, c, t, g, unknown or other
  misc_feature (580)..(580): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttgcgtgaggagccgtgggcctcagtgattcgtcccctgccaggcttccggatatatcttcgacttctattattacacgtgggtcnccgccgtaggtccccgtggaacgaagggcctaggaggtgggagtggggatggactaatacccaacccagaactggaccaccaacaagtctagcaaacgagtaacgttcgagggcagggtcacatcgacccgagaccncgtacatacaaactacacgtcctaaccgnggtaaacctcgaacgtccttaaaccctaaagttccaacgaaccgacaccggtaccttagtacttcgtgtcggacgtaagacggttcagttacgtacctagttaggttattaggttcgttacggtttngttggttctttaacggttgttccggg

SEQ ID NO: 338661 - DNA, 542 bp, Homo sapiens
  misc_feature: GZ8MTXP01DYY3X.38.27.C05.1.454.CMB.2.raw
  modified_base (288)..(288): a, c, t, g, unknown or other
  misc_feature (288)..(288): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcgagtgattgtcccctgccaggcttccggatatatcttcgacttctactattacactgggtncgccaggtcccctggacaagggcctgagtcggatgggatggcatacaacccagaactggcgacacaaagtctgcaacagaagttcaagggcagggtcacatcgaccgagacacgtccaatcaaatacancctaccgngaactcatcctaccctaaaancgtagaccgacacggccttatattacgtcgtgcgaagacggatagttacgtacgtacgttagttagttagtgtcgttcgtgtgttcttgttgttcg

SEQ ID NO: 338662 - DNA, 562 bp, Homo sapiens
  misc_feature: GZ8MTXP01BP1G4.38.27.C05.1.454.CMB.2.raw
  modified_base (506)..(506): a, c, t, g, unknown or other
  misc_feature (506)..(506): n is a, c, g, or t
  modified_base (538)..(538): a, c, t, g, unknown or other
  misc_feature (538)..(538): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgacttctactattacactgggtgcgccaggtcccctggacaagggcctgagtggatgggatgcatccaacccagaactggacgaaccacaaagtctagcaaacagaacgtttcgagggtcaggggtcaccgatacgacccgagacacgtccatacaatacagcctacgtacgaactacacgactaccctaaaatcctacgaccgacgaccggactcctattacctgtcgcgaagagcagngtccgtacttggttattaagtgtcggtttcgnttgttcttttgttaagttttcggg

SEQ ID NO: 338663 - DNA, 660 bp, Homo sapiens
  misc_feature: GZ8MTXP01D33ET.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagttattcgtcccctgccaggccttccggatatatcttcgacttctactattacactgggtgcgccaggtccctggacaagggcctgagtggatgggatgcactcaaccccagaactggacacacaagtctgcacgaagtagtttcgagggcgagggtcaccgatcgacccgagacacgtccatacaaactacacgtacctaaccgtacggaactcaacgtcccttaacccgttaaaactccttacgaccggaaccgaccgggtcccgttacttactttaacgtcggttacggcggtaagggaacgggtacgaacggtacgtttacccgtaaccggttttagggttaaacgtttaaagggttcggtttaaccggggttttaccgtaacggttttggtaccgtttttagttaacgttttcgggttaaccggggg

SEQ ID NO: 338664 - DNA, 575 bp, Homo sapiens
  misc_feature: GZ8MTXP01AQXF6.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggaagcctggggcctnagtgattgtcccctgccaggcttccggatatatcttcgacttctactattacactgggtgcgccaggtccctggacaagggcctgagtggatgggatgcatccaacccagactggacgaccacaaagtctgcaacagtaagttcgagggcagggtcacgatcgaccgagacacgtcatcaatacacacctacctaggaactacacgtacctaacctaaatcctacgaccgacgaccggtccgtactacttcgtcgtcgcgaagacggcacgacgttaccgtacgttaggttacttaaggtcggttacggttttcgtacgttgttacgtttttggttcgttttaaccgggg

SEQ ID NO: 338665 - DNA, 668 bp, Homo sapiens
  misc_feature: GZ8MTXP01AHN06.38.27.C05.1.454.CMB.2.raw
  modified_base (168)..(168): a, c, t, g, unknown or other
  misc_feature (168)..(168): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctggtttggcgtgaggagcctggggcctcagtgattgtcccctgccaggcttccggatatatcttcgacttctactattacacgtgggtgcgccaggtcccctggacaagggcctggagtggatggggatgcataccaaccccagaactggaccgaccaacgaaagtctagaccaaacaggtaagtttcgaggggctaggggtccacgataccgaacccgagaaccaccgtccaactacaaacgtaccacgtaccctaacgtacggaaacctcacgtaccctaacctaaaacgtcctaacgaaccgaccgaccggtaccgttacttaacttaccgtacggtacgaccgggaaggacgggacgtaacggttaccgttaacccgttaacggtttcgggttaaagttaacgggttcggttacgggttttaaccgtaagttcggtttccgtttttaagttaacggttttccggggg

SEQ ID NO: 338666 - DNA, 566 bp, Homo sapiens
  misc_feature: GZ8MTXP01EVIJT.38.27.C05.1.454.CMB.2.raw
  modified_base (169)..(169): a, c, t, g, unknown or other
  misc_feature (169)..(169): n is a, c, g, or t
  modified_base (499)..(499): a, c, t, g, unknown or other
  misc_feature (499)..(499): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaaggngcccactcccaggtgaaattggtccagtcgtgggtttggcgtgaggaagccgtggggcctcagtgattcgtcccctgccgaggtcttccggatatatcttcgactttctacttattacacgtgggtgcgccaggtcccctggacaagggcctgagtggatgggatgcatccaaccccagaactggacaacacaaagtctagcaaacagtaagtttcgaaggggcgaagggtcaaccagtaccgaccgagaccacgtcaatacaatacacgacctacgacgaacacgacgacctacctaaaatctagaccacgacgcgtactatactgtgngaagaggcacgttagttaccagttagttattaagtggtgtttcgatggttctttggttcgtttcggg

SEQ ID NO: 338667 - DNA, 571 bp, Homo sapiens
  misc_feature: GZ8MTXP01DHYHE.38.27.C05.1.454.CMB.2.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (493)..(493): a, c, t, g, unknown or other
  misc_feature (493)..(493): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggcttccggatatatcttcgacttctactattacactgggtncgccaggtccctggacaagggcctgagtggatgggatgcatcaacccagaactggcgaccacaaagtctagcaacaagtaagtttcgaggggcaggggtccacatacgacccgagacacgtcatacaaatacacgacctacagaactcacgacttaccctaaaatctagaccgaccgaccggtcgtactacgttactgtcgcgaagnggactagacgtttacccagtttaggttattaacggttgtcggttttcgacgttgttcgttttgttcgttttaaccggg

SEQ ID NO: 338668 - DNA, 617 bp, Homo sapiens
  misc_feature: GZ8MTXP01EL7IC.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggtccttaccggatatatcttcgtacttctactattacacgtgggtgcgccaggtccctggacgaaggcctggagtggagtgggatgcataccaaccccagaactggaccaaccaactaaaagtctagaccaaacgaagtaaggtttacaaggggtcacgggtaccacgatacgacccgagaccacggtacaacgtacaaatacaacgaccctaacgttcgaaactacacgtacctaaaccctaaatcctacgaacgaccgaccgtccgtattacgtactgtacgcggaacgtagctaaggttactcgtaacgttggttacttaggttcggtacggtttctagttacgttcgttttgttcgtttaacgggg

SEQ ID NO: 338669 - DNA, 663 bp, Homo sapiens
  misc_feature: GZ8MTXP01DBUZR.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcgtgggcctnagtgattcgtccctgccaggtcttccggatatatcttcgacttctacttattacacgtgggtcgcgccgacggtccctggacgaagggcctgaggtggagtgggatggcactaccaaacccagaacgtggaccaaccaacaaagtctagacaaacagtaacgttcgaaggggtccgagggccaacgagtaccgacccgagaccacgtaccatacaaactacacgaccctaacgacgaactcgaacaccgttaacctaaaactccgtaacgaccgaaccgtaccgggtacccgttacttaacttacgtcgttccggaacgggtaacgaacgggccgtaaacggttaccgttaaccgtaaccgtttacggttaacgttaaaggttcggttacggttttccgtaagttcgtttaccgttttaaggttaacgttttccgggg

SEQ ID NO: 338670 - DNA, 590 bp, Homo sapiens
  misc_feature: GZ8MTXP01BJZ7C.38.27.C05.1.454.CMB.2.raw
  modified_base (291)..(291): a, c, t, g, unknown or other
  misc_feature (291)..(291): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggctttggcgtgaggaagccgtggggcctcagtgattcgtcccctgccaggcttccggattatatcttcgcttctactatttacacgtgggtncgccacggtccctggacgaggggcctggagtggatggggatgcatccaaccccagaactggccacacaagtcagacacaagtaagttcgagggcgacgggtacacgatacgacccgagacgacgtcactacaactacacgaccctacgtacggaactaccgacggtacctaacccttaaaactcgtacgaaccggaccgtaccggtcccgttacttacttacgtgtgcgagacggcgagtacgttcttacgttggttactaagggtcgttcggtttcgtagttgttcgttttgtaacgg

SEQ ID NO: 338671 - DNA, 630 bp, Homo sapiens
  misc_feature: GZ8MTXP01B5FSN.38.27.C05.1.454.CMB.2.raw
  modified_base (440)..(440): a, c, t, g, unknown or other
  misc_feature (440)..(440): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggcttccggatatatcttcgacttctactattacactgggtgcgcacggtccctggacaagggcctgagtggagtgggatgcactaccaaccccagaactggacaccacaaagtctgcaaacagtaagtttcgaggggcagggtaccacagtcgaccccgagaccacgtacactacaaactcacgccctaccgnggaactcacgcctaaccctaaaagtcctacggaaccgaccgaccggtccccgttacttaacttacccgttaggtccgcggaacggacgggacacgggttaacgtttcccgtaacggtttggttagttaaacggttcggtttccgggttttaagtacgttggttactttttcggttaacgtttttccgggg

SEQ ID NO: 338672 - DNA, 591 bp, Homo sapiens
  misc_feature: GZ8MTXP01CSAC4.38.27.C05.1.454.CMB.2.raw
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctccagatacgaccggagaaagtgtgttgacgcagtctccaggcaccctgtctttgtctccgagggagagagccaccctctcctgcagggccagtcagactagtagngcagctactgcctgtaccagacaaaactgcagcnccagctcncattangtnccgtccacgnggccacgtggcactccagacagtatcgagtggcagtgcgtcgtgggcagtactcactcgtcgtnactcgaanagactcggaacccaagtagttagtttgcttaggttattacttacgtagtacaacgtacttagtcgggttacttccggcgttacggtaccggttcggaccgtaaacggggtacctaaaggggtcggtaaacgttacgtaaacgttacggtaaacgtggttacggttcgttcgaaccgtaactgtttcccgtagtttcccttaacgaaccttttccccg

SEQ ID NO: 338673 - DNA, 610 bp, Homo sapiens
  misc_feature: GZ8MTXP01EV2ZE.38.27.C05.1.454.CMB.2.raw
  modified_base (407)..(407): a, c, t, g, unknown or other
  misc_feature (407)..(407): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgtcccctgccaggcttccggatatatcttcgacttctactattacactgggtgcgccaggtccctggacaagggcctgagtggatggatgcatcaacccagaactggcgacacaaagtctgcaacagaagtttcagggcagggtccacatcgacccgagacacgtccatacaaanacacgcctaacctcgaactacgacgccgtacccttaaaatccgtacgaaccgacaccgggccgtactacttacctagttcgccggaaggacggacgaacggttagttaccccgtaacgtttagggttaattaacggttcgggttaccgggtttttaaccggaagtttggttacccgttttttgttaacgttttttcccggggg

SEQ ID NO: 338674 - DNA, 643 bp, Homo sapiens
  misc_feature: GZ8MTXP01ED6J7.38.27.C05.1.454.CMB.2.raw
  modified_base (289)..(289): a, c, t, g, unknown or other
  misc_feature (289)..(289): n is a, c, g, or t
  modified_base (351)..(351): a, c, t, g, unknown or other
  misc_feature (351)..(351): n is a, c, g, or t
  modified_base (548)..(548): a, c, t, g, unknown or other
  misc_feature (548)..(548): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttccggatatatcttcgacttctactattacactgggtncgccaggtccctggacaagggcctgagtggatgggatgcatccaacccagaactggcaccanaaagtctagcaaacgaagtaacggtttacgaggggtaccgaggggtaccaaccgagttaccgaaaccccggaagtaaccgaaccggtcccaataccaaacttaccaacgtaccctaccgtacggaaactcaacgtacccttaaccctaaaatcctacgaaccgacgaccggtccgtacttacttacgtgtgcgaagnggttacacggttacgttcccgtaaggtttgttagttaacggtggtttacgggttttaacgtgttacgtttcttttggttaacgtttttccggggg

SEQ ID NO: 338675 - DNA, 554 bp, Homo sapiens
  misc_feature: GZ8MTXP01DLZFG.38.27.C05.1.454.CMB.2.raw
  modified_base (228)..(228): a, c, t, g, unknown or other
  misc_feature (228)..(228): n is a, c, g, or t
  modified_base (496)..(496): a, c, t, g, unknown or other
  misc_feature (496)..(496): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggcttccggatatatcttcgacttctactattacactgggtgcgccaggtccctggacaagggcctgagtggatgggatgcatcaaaccccagaactggcgaacacaaagtctgacaaacagtaagtttcgaaggggacacggggtaccaccatcgaccctagacacgtaccatacaaatacacgacctacctagaaactcacgactaccctaaaactctagacacacggcgtactatactgtgcgaagnggcagacgtcacttggttattagtgtcggtttcgattgttctttgttaacgtttcggg

SEQ ID NO: 338676 - DNA, 635 bp, Homo sapiens
  misc_feature: GZ8MTXP01DSB1D.38.27.C05.1.454.CMB.2.raw
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (288)..(288): a, c, t, g, unknown or other
  misc_feature (288)..(288): n is a, c, g, or t
  modified_base (407)..(407): a, c, t, g, unknown or other
  misc_feature (407)..(407): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggtttggcgtgaggagccgtgggcctnagtgattcgtcccctgccaggtcttcggatatatcttcgacttctactattacacgtgggtncgccaggtccctggacaagggcctgagtggagtgggatgacataccaacccagaactggacaccacaagtctagcaaacagtaagttcgagggtcagggtaccagacgaccgaccgaanaccgtacactataacaactacgacctacctacgaacgtacctacacccgtaccgttaaaccctaacgtaccgaaccggaccgtaacccgtccggttacccgttacttaaccgttcgtacgtcggaacggtaaggcggttacgtacgttaccgttacgtacgtttaaggttagttacgggttcgtttacggttaagtgttcgtttgtttaacgttcggtttaaccgggg

SEQ ID NO: 338677 - DNA, 555 bp, Homo sapiens
  misc_feature: GZ8MTXP01BNCEH.38.27.C05.1.454.CMB.2.raw
  modified_base (364)..(364): a, c, t, g, unknown or other
  misc_feature (364)..(364): n is a, c, g, or t
  modified_base (529)..(529): a, c, t, g, unknown or other
  misc_feature (529)..(529): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggagcctggggcctcagttatgtcccctgccaggcttccggatatatcttcgacttctactattacactggtgcgccaggtcccctggacaagggcctgagtggagtgggatgcactaccaaccccagaactggacacaaccaaagtctgacanaagtaacgttcgagggcgagggtcacagtcgacccgagacacgtacatacaatacacgacctaccgtagaactcagtcctaaccgtaaatctagacgacaccgcgttctattactggtcgcgaggaagcagtacgttcgtacgttgttagttagttgtcgtttgnttgtatttgtaagtttcgtaacgggg

SEQ ID NO: 338678 - DNA, 577 bp, Homo sapiens
  misc_feature: GZ8MTXP01DQG9M.38.27.C05.1.454.CMB.2.raw
  modified_base (287)..(287): a, c, t, g, unknown or other
  misc_feature (287)..(287): n is a, c, g, or t
  modified_base (431)..(431): a, c, t, g, unknown or other
  misc_feature (431)..(431): n is a, c, g, or t
  modified_base (486)..(486): a, c, t, g, unknown or other
  misc_feature (486)..(486): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgccaggtcccctggacaagggcctgagtggatggatgcatccaaccccagaactggcgaaccacaaaagtctagcaacagtaagtttcaggggcagggtcaccgagtacgacccgagacacgtcatcaatacacgcctaccgngaactcgacgactacctaaatctagacgcacgctactattacctgtcgcgtaagnggcagttacgttcccgtagttagggttacgttaaggttggttaccgggtttttcgtagtttggttacctttttgttaacgtttttccgggg

SEQ ID NO: 338679 - DNA, 659 bp, Homo sapiens
  misc_feature: GZ8MTXP01CYPVS.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattcgtcccctgccaggcttccggatatatcttcgacttctactattacactgggtgcgccaggtcccctggacaagggcctgagtggagtgggatggcataccaaaccccagaaactggaccgaaccacaaaagtctagacaaacaagtaagtttcaaggggcaaaggggtccaaccagtacgacccgagaccacgtccataccaaatacacgaccctacagaactacacgcctaaccctaaaatctacgaacgaaaccgaccggtccgtaccttattaccgtggtacggaccggtaaaggtaacggggacctaaaggggttaactttaccccgaacgtttttagggttaacgttaaaagggttcgggttacccggggtttttgaaccgtttggttccgttttttaagaacggttttttaaccgggg

SEQ ID NO: 338680 - DNA, 744 bp, Homo sapiens
  misc_feature: GZ8MTXP01C9BKZ.38.27.C05.1.454.CMB.2.raw
  modified_base (168)..(168): a, c, t, g, unknown or other
  misc_feature (168)..(168): n is a, c, g, or t
  modified_base (183)..(183): a, c, t, g, unknown or other
  misc_feature (183)..(183): n is a, c, g, or t
  modified_base (287)..(287): a, c, t, g, unknown or other
  misc_feature (287)..(287): n is a, c, g, or t
  modified_base (709)..(709): a, c, t, g, unknown or other
  misc_feature (709)..(709): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtnaaattggtccagtcgtgggtttggcgtgaggagccgtggggcctcagttatcgtccctgccaggcttcggatatatcttcgacttctactattacactgggtcncgccacggtccctaggacgaagggcctggagtggagtgggatgcactaccgaaccccgagaactggacgacaaccgtaaacgtctacgacaacgtaaaggtaaacgtttcgacggggtacgaacggggtaccaaccgaacgttacggaaaccccggtaagaacccgtaaccggtaccctaaagttaaccctaaacgtaaacccgtaaccgggttacccctaaacccgggtttacgggaaaccccgttaaccaaccgttaaccccttaaaccccgtttaaaacgttcccgttaacggaaccccgaaacccggtaccccggtacccgttacctttaaacgtttaccgtggttacggaccggaagtaacgaacgttacggttacttacgtacgttaaggttacgttaggttcgttaacggtttanaacgtttgtacgttttgtcgtttcggtaaccgggg

SEQ ID NO: 338681 - DNA, 718 bp, Homo sapiens
  misc_feature: GZ8MTXP01AHAVN.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtggttggcgtgaggagccgtgggcctnagtgattcgccctgccaggcttcggatatatcttcgacttctacttattacacgtgggtcgcgccgacggtccctaggtacgaagggcctaggacggtggagtgggggatggacactacccgaacccgagaaccgtgggaccgaacaacgtaaacgtcgtcgacgaaaccgaaggtaacggtttcggaaggggtccgacggggtaccaaccgtagtacccggaacccgaagaacccgtaccgtacccaacttacgaaacttaccgacgtacccttaaccgtacggtaaacctcgtaacacccgttaacctaaaacgtccgtaacgacccgacgacccgggtaccttacgttaacgttccgtacggttcgcgggtaaggtcggacggtaacggttaccgttacccgtaaggtttacggttaaggttacggttcggggtttcggttttaacgtcggtttcgtttacgtttttaacggttaacgttttcccggggg

SEQ ID NO: 338682 - DNA, 594 bp, Homo sapiens
  misc_feature: GZ8MTXP01D4Q9E.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtccctgccaggcttccggatatatcttcgacttctactattacactgggtncgccaggtccctggacaagggcctgagtggatgggatgcatcaaccccagaactggacgaccacaaagtctgcaacagtaagtttcaggggcagggtcacatcgacccgagacacgtcatacaactacacgcctaacaggaaactcacgctaaccctaaaatccgtacgaccgaaccgacggccgtactacttaacgtgtacgcggtaagacggacgtaacgttacgttacccgtaacgttagggttattaaaggttcggttacgggttttccgtagttgttccgttttggttaacgttttccgggg

SEQ ID NO: 338683 - DNA, 635 bp, Homo sapiens
  misc_feature: GZ8MTXP01AFV2T.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctgggggcctcagtgattcgtcccctgccaggcttccggatatatcttcgtacttctactattacacgtgggtgcgccgaggtccctggacgaagggcctgagtggagtgggatgacactaccgaacccccagaaacgtcggacgaccaacaaagtctagacaaacaagtaacgtttcggaagggtacgacgggtaccaccagtaccgacccgacgaccaccgtaccaatacaaactaccacgtccctaaccgtacggaacctacgacgtacctaacctaaactctacgaccgccgaccgccgttactacttacgtgtcgcggaaggacggttacgtacgttacgttcctaacgtttaggttagttaaggttcggttcggtttaacgtacgttcgttcgttttcgttgttttccgggg

SEQ ID NO: 338684 - DNA, 566 bp, Homo sapiens
  misc_feature: GZ8MTXP01DUXID.38.27.C05.1.454.CMB.2.raw
  modified_base (289)..(289): a, c, t, g, unknown or other
  misc_feature (289)..(289): n is a, c, g, or t
  modified_base (344)..(344): a, c, t, g, unknown or other
  misc_feature (344)..(344): n is a, c, g, or t
  modified_base (350)..(351): a, c, t, g, unknown or other
  misc_feature (350)..(351): n is a, c, g, or t
  modified_base (390)..(390): a, c, t, g, unknown or other
  misc_feature (390)..(390): n is a, c, g, or t
  modified_base (489)..(489): a, c, t, g, unknown or other
  misc_feature (489)..(489): n is a, c, g, or t
  modified_base (538)..(538): a, c, t, g, unknown or other
  misc_feature (538)..(538): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttgcgtgaggaagccgtggggcctcagtgattcgtcccctgccaggcttccggatatatcttcgacttctactattacactgggtncgccaggtccctggacagggcctgagtggatggatgcatcacccagactgcacanaagtcnncaacagtaacgttcgagggcagggtcacagtacgaccanacacgtcatacaatacagaccctacgtagaactcacgaccttaaccctaaatcgtacgacgaaccgaccggtcctactagttacctggtcgacggaagnggctaggacgttaccctagtttaggttattacggtgtttaccggttttnagtttgttcgttttgttaacgtttcggg

SEQ ID NO: 338685 - DNA, 656 bp, Homo sapiens
  misc_feature: GZ8MTXP01AUU0Q.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctggtttggcgtgaggaagccgtggggcctcagtgattcgtcccctgccgaggtcttccggatatatcttcgacttctactattacactggtgcgccaggtcccgtggacaagggcctggagtggatgggatggcactaccaaccccagaactggacaaccaacaaagtctagcaaacgagtaacgttcgagggacgacgggtccaacgagtcgacccgagacacgtaccaagtacaaactacacgtaccctaaccgtacgaacctcaacgtaccctaaccctaaaactccgtacgaccgaaccgtaccggtacccgttacttacgttaacgtggttacggacggaacggaggttaccgtacgggttacgttacccgtaacgtttagggttaagttacgggttcggttccggttttaacgtagtttcggtttcgttttaagttaacgggttttccgggg

SEQ ID NO: 338686 - DNA, 638 bp, Homo sapiens
  misc_feature: GZ8MTXP01BK4MQ.38.27.C05.1.454.CMB.2.raw
  modified_base (409)..(409): a, c, t, g, unknown or other
  misc_feature (409)..(409): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctactattacactgggtgcgccaggtcccctggacaagggcctgacgtggatgggatgacatccaaccccagaactggcgaaccaactaaagtctgaccaaacagtaagttcgagggcagggtaccacatacgacccganacgaccgtccatacaaactacacgtaccctaaccgtacggaaactcaacgacctaaacccctaaatctacgaccgaccgaccggtccgttactattaccgtgtacgcgggaaggacggcgaaacggttcgttaccccgtaacgtttacggggttaagttaaacgggttcggttacccgggggtttttcgtaggttcggttttacgttttaacgttaacggttttccggg

SEQ ID NO: 338687 - DNA, 629 bp, Homo sapiens
  misc_feature: GZ8MTXP01AX1F7.38.27.C05.1.454.CMB.2.raw
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctgggcctnagtgattgcccctgccaggcttccggatatatcttcgacttctactatacactgggtncgccaggtccctggacaagggcctgagtggatgggatgcataccaacccagaactcggacgaaccaacaagtctgccaaacagtaagtttcgagggcacggggtcacgatcgacccgtagacacgtccagtacaactacacgacccttaaccgagaaactcaacgaccttaaccctaaaagtctacgaacgaccgacgacccggttactactttaacgtcgtacggcggaacgtaagggcctaaaggttaccgtttaccgtaaccgtttaggttaagttaaacggttgggttaccgggttttaacgtaacgtttcggttacctttttggttcgttttaacccggggg

SEQ ID NO: 338688 - DNA, 545 bp, Homo sapiens
  misc_feature: GZ8MTXP01DOPQ3.38.27.C05.1.454.CMB.2.raw
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttcgatatatcttcgacttctactattacactgggtgcgccaggtcccctgacaagggcctgagtggatggggatgcatccaaccccagaactggcgacacaaagtctgcaacagtaagttcaggggcagggtcacatcgacccgagacacgtaccatacaatacacncctaccngaactcagcctaccctaaaatctagaccgacgccgccgtctattactgtgcgaagagcagcgtccgtacttggttattaagtggtcggtttcgtattgttccttttgttaagttttccggg

SEQ ID NO: 338689 - DNA, 630 bp, Homo sapiens
  misc_feature: GZ8MTXP01ASBUB.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccgaggtccctggacaagggcctgagtggatgggatgcatccaaaccccgagaactggacaaccacaaagtctgacaacagtaagtttcgagggtcacggggtcacgatcgacccgagaccacgtccaatacaactacacgacctaacccgtacggaacctcgacgaccctaacccttaaaacgttccgtaacgaaccgaaccgaccgggtcccgttacttacgttaccgttggtcgcgggtaagacgggcgtaaggttacgttacccgtacgtttgggttacgttaggttgggttcggttttcgtaagttcggtttcgttttaagttaacgttttccgggg

SEQ ID NO: 338690 - DNA, 630 bp, Homo sapiens
  misc_feature: GZ8MTXP01BAIJE.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttcggatatatcttcgacttctactattacactgggtgcgccaggtcccctggacaagggcctgagtggagtgggatgcatccaaccccagaactggcaccacaaagtctgcaacagaagtttcagggcagggtcacgatcgacccgagacacgtccatacaactacacgtacctaccgtagaacctacacgacctaacccgtaaaattccgtacgaaccgaaccgaccggtcccgtacgttaacttaccgtagttacggcggaacggaacggttacgaacgttacggttacccgtaacgtttcgggttaagttaaacgggttgggttccgggtttttaacggtagtttcgttaccgtttttggttaacgttttcccggggg

SEQ ID NO: 338691 - DNA, 579 bp, Homo sapiens
  misc_feature: GZ8MTXP01A8NZ7.38.27.C05.1.454.CMB.2.raw
  modified_base (288)..(288): a, c, t, g, unknown or other
  misc_feature (288)..(288): n is a, c, g, or t
  modified_base (427)..(427): a, c, t, g, unknown or other
  misc_feature (427)..(427): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcgagtgattgtcccctgccaggcttccggatatatcttcgacttctactattacactgggtncgccaggtccctggacaagggcctgagtggatgggatgcatccaaccccagaactggacgaccacaaagtctagcaaacagtaagtttcgagggcagggtccacagtacgaccgagacgacgtcaatacgaaatacacncctaaccgtagaactcacgacctaacctaaatcacgaccgacgaccggtccgtactattacgtgtcgcggaagagctagacgttacctagttcggttattaacggtcggttcgggttttcgagttcgttccttttaaggttcgtttaacggg

SEQ ID NO: 338692 - DNA, 588 bp, Homo sapiens
  misc_feature: GZ8MTXP01BSOZN.38.27.C05.1.454.CMB.2.raw
  modified_base (222)..(222): a, c, t, g, unknown or other
  misc_feature (222)..(222): n is a, c, g, or t
  modified_base (510)..(510): a, c, t, g, unknown or other
  misc_feature (510)..(510): n is a, c, g, or t
  modified_base (557)..(557): a, c, t, g, unknown or other
  misc_feature (557)..(557): n is a, c, g, or t
tcagtcgatcacgtcacgaccggtgctcgatttagacgcgatcgaagggtttgggggagagcatcacccagcaaccacatctgtcctctagagaatcccctgagagctccgttcctaaccatggactggacctggaggatcgtcttcttggtggcagcagtcaaaggagcccactcccaggtgaaattggtccagtctggttggcgtgagagcctgggcctnagtgattgtcccctgccaggcttccggatatatcttcgacttctactattacacgtggtgcgcctaggtccctggacaagggcctgagtggagtgggatgcactaccaaccccagaactggaccgacaaccaaacgtctgacaacgaaagtaagtttcgagggcgtagggtcaaccgatcggacccgagtaccacgtaccagtacaaatacgacgtacctaccgagaacctcaacgtacctaaccgtaaatcgtacgacgacaccgccgttactacttctgtcgacgngaaggcaggtacgttcgtacgttgttaacgttgttggttccggtttnaagttcgtagtttgtcgtttcggtaacgggg

SEQ ID NO: 338693 - DNA, 594 bp, Homo sapiens
  misc_feature: GZ8MTXP01D5Q0B.38.27.C05.1.454.CMB.2.raw
  modified_base (291)..(291): a, c, t, g, unknown or other
  misc_feature (291)..(291): n is a, c, g, or t
  modified_base (519)..(519): a, c, t, g, unknown or other
  misc_feature (519)..(519): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgcgaggaagccgtggggcctcgagtgattcgtcccctgccaggcttcggatatatcttcgacttctactattacacgtgggtncgcaggtccctggacagggctgagtggatgggatgcacgtaccaaaccccgagaaactggacaaccaaccgaaagtctgacaaacagtaaggtttcgaaggggtcacgggtcacgatacgacccgagaccacgtcaatacaaatacacgaccctacaggaactcaagaccttaacccctaaatccgtagacgaccgacggcccttatacttacgtgtacgcggaaggngcagttacgtccctaagtttggttaattaacgtggttccggtttgagttcggttacttttgttaacgtttcgggg

SEQ ID NO: 338694 - DNA, 626 bp, Homo sapiens
  misc_feature: GZ8MTXP01DEJ9K.38.27.C05.1.454.CMB.2.raw
  modified_base (228)..(228): a, c, t, g, unknown or other
  misc_feature (228)..(228): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctnagtgattcgtcccctgccaggtcttccggatatatcttcgacttctactattacacgtgggtgccgccacggtcccctggacaagggcctgagtggatggggatgctacgtaccaaaccccgagaacgtggaccgaaccaacgtaaaacgttctaggaccctaaaacgaaggtaacggtttcgacggggtacacggggtccaaccgagtacgacccgagaccacgtccagtacaaactcacgccctacgtacgaacctcacgtcctaaccctaaatcgtacgaccgaaccgacgtccgttactacgttacctgtcgcgaagcggacaggttcgttaccctagttacggttaattaggttgttcggtttcgagtcgtttgtttgttaacgttttccggg

SEQ ID NO: 338695 - DNA, 660 bp, Homo sapiens
  misc_feature: GZ8MTXP01AY70B.38.27.C05.1.454.CMB.2.raw
tcagtcgatcacgtcacgaccggtgctcgatttagacgcgatcgaagggtttgggggagagcatcacccagcaaccacatctgtcctttagagaatcccctgagagctccgttcctcaccatggactggacctggaggatcgtcttcttggtggcagcagtcaaaggagcccactcccaggtgaaattggtccagtcgtgggttggcgtgaggaagccgtggggcctcagtgattcgtcccctgccaggtcttccggatatattcttcgacttctactatttacacgtgggtcgcgccgacggtcccctggaacgaagggcctggaggtggagtgggatggcactaccaaccccagaacgtggacaacaaccaaagtctacgacaacgaaagtaaacgtttcggaagggtcgaacgggtaccaacgacgtacgaacccgagaccgactacatacaagtaccacgacctacgtacgacctacgactacctaacccgtaaatccgtaacgaaccgaaccgacccggtacttacttacttaccgtgtacggaccgaaggaacgtacgagttacgttacccgtaagttaggttaagttaggttcggttaacggttttaccgtaagtttcggttcgttttagttaacgtttcggggtaaccgggg

SEQ ID NO: 338696 - DNA, 539 bp, Homo sapiens
  misc_feature: GZ8MTXP01DV9WR.38.27.C05.1.454.CMB.2.raw
  modified_base (227)..(227): a, c, t, g, unknown or other
  misc_feature (227)..(227): n is a, c, g, or t
  modified_base (399)..(399): a, c, t, g, unknown or other
  misc_feature (399)..(399): n is a, c, g, or t
  modified_base (482)..(482): a, c, t, g, unknown or other
  misc_feature (482)..(482): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcgtggggcctnagtgattgtcccctgccaggtcttcggatatatcttcgacttctactattacacgtgggtgcgccgaggtcccctggaccaagggcctgagtggatgggatgcatccaacccagactggcacacaagtctgacaacagtaacgttcgagggacagggtccacatcgaccganacacgtaccatacaataccagacctacgtacgaactcacgtactacctaaatctacgacacgcgactctatactgtgcgaagngcagttgtctagttcggttattaggtgttagtttcgngttnttgtttcgngtttcgg

SEQ ID NO: 338697 - DNA, 693 bp, Homo sapiens
  misc_feature: GZ8MTXP01EWSXG.38.27.C05.1.454.CMB.2.raw
  modified_base (292)..(292): a, c, t, g, unknown or other
  misc_feature (292)..(292): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcgagtgattcgtcccctgccaggcttcggatatatcttcgacttctactattacacgtgggtcncgccaggtccctggaacagggcctggagtgagtgggatgcataccaacccgagaacgtggacgacccaacgtaaagtctacgaccaaacgtaagtaacgtttcgacggggtaccgacggggtaccaaccgacgttaccggaacccggaagaccgtaaccggtccaacgttaccaaacgttaccacggtacccctaccgtacggaaccttaccgaacgtacccgttaaccccttaaaatccgttacggaaaccgaaccgtacccggtaccgttacgttaacttaccctggtaccgacggtaaggaaccgggttgtacggttaacgttcccgtaagtttaggttagttaacgggtcgtttacgggtttcgagtttcgttacgttttggttaacgttttcgggg

SEQ ID NO: 338698 - DNA, 714 bp, Homo sapiens
  misc_feature: GZ8MTXP01ACLI1.38.27.C05.1.454.CMB.2.raw
  modified_base (169)..(169): a, c, t, g, unknown or other
  misc_feature (169)..(169): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggngcccactcccaggtgaaattggtccagtcgtgggtttggcgtgaggaagccgtggggcctcgagtgattcgtcccctgccaggcttcggatatatcttcgacttctactattacacgtgggtgccgccacggtcccctaggacgaacgggctggaggtcggagtggggatggacactaccaaacccctagaacgtcggacaaccaacgaaagttcacacgaaacgaggttaacggtttcgaacggggtacgtaacggggtaccaacctaggtacccggaacccgaaggtaacccaaccggttaccaacttacgaaacttaccgacgtaccccgttaacgtacggaaaccgtccaaaccggtaccttaaaccctaaaacggtttcctaaaccggacccgtaaacccgaccggtacctttaccgttaatttaccgaggtcgacggtaaggcgttacgtacggttacgttccgtaaggtttggttaacgttagggttcggtttccggtttaagtgttcggttccgtttttggaaccggttttccgggg

SEQ ID NO: 338699 - DNA, 690 bp, Homo sapiens
  misc_feature: GZ8MTXP01CNNO6.38.27.C05.1.454.CMB.2.raw
  modified_base (234)..(234): a, c, t, g, unknown or other
  misc_feature (234)..(234): n is a, c, g, or t
tcagtcgatcacgtcacgaccggtgctcgatttagacgcgatcgaagggtttgggggagagcatcacccagcaaccacatctgtcctctagagaatcccctgagagcctccgttcctcaccatggactggacctggaggatcgtcttcttggtggcagcagtcaaaaggacgccccactcccaggtagaaattggtccagtcgtgggtttggcgtgaggaagccgtggggcctnagtgattcgtcccctgccgaggtccttccggatattatcttcgacttctaacttattacacgtgggtgccgcctaggtcccctaggacgaagggcctgaggtggagtgggatgctaactaccaaaccccgagaaccgtggacctaaacccgaacaaaagtctacggactaaacgaaggttaacgttcgaaggggcgtacggggtaccaacgagtaccggaacccgagaccaccgtacaactacaagtaccacgtaccctacgtacgaaacctcgaaacctacccttaaaccctaaaactcgtacgaacccgaaccgacccggtccgttactacgttaccttgggtccgacggtaagacggacgaaacggttccgttacctacggtttaggttagttaacgggttcggttaaccggtttgtacgttggtttcgtttaacggttcgtttaacccgggg

SEQ ID NO: 338700 - DNA, 632 bp, Homo sapiens
  misc_feature: GZ8MTXP01BDE2P.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattgtccagtctggttgcgtgaggagccgtggggcctcgagtgattcgtcccctgccaggcttccggatatatcttcgacttctactattacactgggtgcgccaggtcccctggacaagggcctggagtggagtggggatggcactccaaccccagaactggacgaccacaaagtcagcaacagtaacgttcgagggcgagggtcacgatacgacccgagaccacgtccaatcgaaatacacgaccctaccgacgaactcaacgaccttaaccctaaaactccgtacgaaccgaccgaccggtaccgtaccttagttacgtggtacggacggtaaggacggacgacggttaccgttaccgtaaccgtttaggttagttaaacgggttcgggttaccggttttaacgacggtttcgtttaccgttttaagttcggttttaaccgggg

SEQ ID NO: 338701 - DNA, 623 bp, Homo sapiens
  misc_feature: GZ8MTXP01E0KS5.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattcgtcccctgccgaggcttccggatatatcttcgacttctactattacacgtgggtgcgccgacggtcctggacaagggcctgagtggatggatgcatccaaccccagaacgtggacgaccacgaaatctgacaacagtaagtttcgagggcagggtacaccgatacgaccgagaccacgtcaatacaaactacacgacctaccgtacgaactacgacaccgtaacccttaaaatcctacgaaccgaccgacgggtacccttactacgtttacgtaggtacggacgaagggacgttacgaacggttacgttacccgtaagttacggttaagttaacggttcgggttcggttttccggtagttggtttacgttttgttaaggttttcccgggg

SEQ ID NO: 338702 - DNA, 700 bp, Homo sapiens
  misc_feature: GZ8MTXP01B8M3X.38.27.C05.1.454.CMB.2.raw
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (482)..(482): a, c, t, g, unknown or other
  misc_feature (482)..(482): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggttggcgtgaggaagccgtgggcctnagtnattcgtccctgccaggcttcggatatatcttcgtacttctacttattacacgtgggtcgcgtccgacggtcccctagggaccgaagggcctaggtagtggagtgggatgacactaccaacccgagaacgtggaccacaacaaagtctagaccaaactaaggtcgtttacgaggggcgacgggtaccaacgacgtaccgacccgagacctacgtaccaactacgaaactacgacgtaccctacgtagtaaacncgtaactaccttaaccctaaattccgaacgaaccgtaccgtacccggtacccgttacttaacgttaccgtaggtcgaacgggaaacgtacgggttacgtaacggttaaccgtttaccgttaaccggtttagggttaaactttacggggttcggtttaccggttttccggttaagttcggttttaccgttttaagggttaacggtttttaacccggggg

SEQ ID NO: 338703 - DNA, 706 bp, Homo sapiens
  misc_feature: GZ8MTXP01D7PDQ.38.27.C05.1.454.CMB.2.raw
  modified_base (373)..(373): a, c, t, g, unknown or other
  misc_feature (373)..(373): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgacttctactattacactgggtgcgccacggtccctaggacaagggcctgaggtggatgggatgcgataccaaccccaagactggacgaaccaacgaaaagtcgtanacaaaccgtaaggtaacggttttcggaaacgggggaccaacgggggttacccaaccgtaagttaccggaaccccggaagaacccgtaaccggttacccaattaccaaaacttaccgaacgacccctaaccgtacgggtaaacctacgaaccgtaaccttaaacccccttaaaattccttacggaaccgaaccgtaccgggttacccttacgttactttaacgttggacggtcggaaggagccgtaacgttacgttaccgtacgtttaggttattaaacggttggttaccggttttgtagttcgttcgttttttaacgttaacgtttttcgggg

SEQ ID NO: 338704 - DNA, 702 bp, Homo sapiens
  misc_feature: GZ8MTXP01D90DA.38.27.C05.1.454.CMB.2.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (622)..(622): a, c, t, g, unknown or other
  misc_feature (622)..(622): n is a, c, g, or t
  modified_base (636)..(636): a, c, t, g, unknown or other
  misc_feature (636)..(636): n is a, c, g, or t
  modified_base (676)..(676): a, c, t, g, unknown or other
  misc_feature (676)..(676): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggccctgngtgtagttcgtccctgccgaggtccgttacgatattactcttcgtacttctaacttactacacggtgggtcnccgaccgtacggtcccgtaggacgaaacgggtcctaggtaggtggagtaggagtcgactaacctaacccgaaaccccgaagtaacggtcggaaccctaaccgaaaccgtaaacgtccgtacgaaccgtaaaacgtaacggttaaccggttacgaacggggtaccggtaaccgggtacccaaccggtacgtaaccccgggaacccgaacgtaacccgtacccgtaacctaacgtaactaaacgtaccgaccgtaccctacgacgtacctacaccgtacccgttaaactaagtccgacgaaccaccgaccgtcctaatacgttncgtgacgaagcganacgttcgtactgttaagttattacgggttgttacggtttngttgttcgtttaagttgtaaccgggg

SEQ ID NO: 338705 - DNA, 704 bp, Homo sapiens
  misc_feature: GZ8MTXP01DCKO6.38.27.C05.1.454.CMB.2.raw
  modified_base (523)..(523): a, c, t, g, unknown or other
  misc_feature (523)..(523): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggttggcgtgaggaagcgtggggcctcagtgattcgtcccctgccaggtcttccggatatatcttcgacttctactattacacgtgggtcgccgccgacggtccccgtggaaccgaagggtcctggaggtcggagtggggatgctaactacccgaaaccccgaagaaccgtggaccgtaaacccaacgtaaagtccgtagaccaaacgaaacggttaacggttacggaagggacgtacgggtaccaacgacgtacccggaacccgaagaccgtaaccgaccaataaccaaactaccgacgtaccctaaccgtaggtaaaccncgaaccgtaacctaaacccttaaaatccgtacgaaaccgccgaccggtaccttaacttacttacggtgtacggcggaacgacggacgtaacgttacgttaacccgttagttaggttaaacgttaggtttcggttcggttttcgacggtttgttcgttttaacggttaagttttaaccgggg

SEQ ID NO: 338706 - DNA, 598 bp, Homo sapiens
  misc_feature: GZ8MTXP01ETYT4.38.27.C05.1.454.CMB.2.raw
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (558)..(558): a, c, t, g, unknown or other
  misc_feature (558)..(558): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcgagtgattcgtcccctgccaggcttccggatatatcttcgacttctacttattacactgggttgccgccaggtccctggacaaggcctgagtggatgggatgcactacaaccccagaactggacaccacaaagtctncaaacagtaagttcagggcagggtcacgatcgaccanacacgcaancaaacacacgcctacgtacgaactacacgacctaaccctaaatcctacgaccgacgaccggtcctactacttacgtagtcgacgtaagacggctaggacgttcccgtaagttaggggttattaacgggttggttacggttttccgngtttacggttccgtttttaagttaacggtttttcccgggg

SEQ ID NO: 338707 - DNA, 742 bp, Homo sapiens
  misc_feature: GZ8MTXP01BYNKI.38.27.C05.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggccacctgtctttgtctccgagggganagacgcccaccctctcctgcagggccagtcagtactagtaggncagtctactgctgtacagacaaacngcaggctccgagctcctctattagnggtnccgtaccaccgacggccacgtcggaccactcccgagaccagtacttacgacggtcggacgtaggtcgtcggtacggtacggggaactacgtacccgttcgtaccttccgttacgggtactacgtacccggtaacgtacggtaacgtaccgggaaacccaacgttacggtttacttttaggaccgtttgggttacttaacgtttaccgttacgtaacccggtaaacgtttcggtttaaggttccgggggtttcccgttcccggggtaccgggtttacgggttaacccgggtttcccggggaaccgggtaaacggggtacccggttaaagggggtaacggtaaacggttaccgtaaggttacccggtaaacgttgggttcggttccgttacgtaaccggtaaccctgtttccgtcgtttaccctaaccggttaactttccccg

SEQ ID NO: 338708 - DNA, 601 bp, Homo sapiens
  misc_feature: GZ8MTXP01DKRQZ.38.27.C05.1.454.CMB.2.raw
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggtcttccggatatatcttcgacttctacttattacacgtgggtgcgccgacggtcccctggacgaagggcctggaggtgggatggggatgcactaccaacccgagaactggccaaccacaaagtcgtcgacaaacgaagtaacgtttcgaaggggtacgtaggggtacccaacgagtaccggaaccccgagaaccacgtaccataacaataaccacgtaccctacgtacgaactcacgtacctaccctaaatctacgaccacgaccgctactacttcgtgtcgngaagcgnagcgttctacgttggttattagggtgttccggtttgtcgttgttcttttgttcgtttcggg

SEQ ID NO: 338709 - DNA, 642 bp, Homo sapiens
  misc_feature: GZ8MTXP01AIFTT.38.27.C05.1.454.CMB.2.raw
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
  modified_base (604)..(604): a, c, t, g, unknown or other
  misc_feature (604)..(604): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctggtttgcgtgaggagcctggggcctcagtgattgcccctgccaggcttccggatatatcttcgacttctactattacactgggtcncgccaggtccctggacagggcctgagtggatgggatgcactccaaccccagaacgtggacgaaccacaaaggtcngacaacagtaacgtttcgacggggcaacggggtccaccgatacggaccccgtagaaccacgtacccattacaacgttaccacgtaccctaccgtacggtaacctaccgactcccgtaacccctaaatccgtacgaaccgaccgaccgggacccttactacttacctgtcgaccggaagagggctacggttacgttaccgaccgtttagggttaccgttaagggttcggttacggttttaaccgngtttcgggttcctttttaagggttccgtttttcggggg

SEQ ID NO: 338710 - DNA, 630 bp, Homo sapiens
  misc_feature: GZ8MTXP01BTMLX.38.27.C05.1.454.CMB.2.raw
  modified_base (226)..(226): a, c, t, g, unknown or other
  misc_feature (226)..(226): n is a, c, g, or t
  modified_base (229)..(230): a, c, t, g, unknown or other
  misc_feature (229)..(230): n is a, c, g, or t
  modified_base (288)..(288): a, c, t, g, unknown or other
  misc_feature (288)..(288): n is a, c, g, or t
  modified_base (505)..(505): a, c, t, g, unknown or other
  misc_feature (505)..(505): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtacaaaggagcccactcccaggtgaaattggtccagtcgtgggttggcgtgaggagcgtgggcctngtnnttcgtccctgccaggtcttcggatatatcttcgacttctacttattacacgtgggtcncgccgtacgtcccgtaggacacgggcctggagtgggagtgggactgaccactaccaaacccgagaacgtggaccgaaccaacgaaagtctagaccaaacgtaagtaacgttcgagggtacgtacgggtaccaacgtacgtaccggaacccgtagaccgtacgacctaatacaaacgtacacgtaccctacgtacgaactcaacgtacctaacctaanccgtacgaaccgaccgtaccggctactagtaccgtgacgtgaagtacgacggtacgttcgttacctagttagttacgttagttcggttacgtttcgtagttcgttcgtttaagttcggtttcggg

SEQ ID NO: 338711 - DNA, 760 bp, Homo sapiens
  misc_feature: GZ8MTXP01EYDLH.38.27.C05.1.454.CMB.2.raw
  modified_base (168)..(168): a, c, t, g, unknown or other
  misc_feature (168)..(168): n is a, c, g, or t
  modified_base (293)..(293): a, c, t, g, unknown or other
  misc_feature (293)..(293): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggtttggcgtgaggagccgtggggcctcagtgattcgtcccctgccaggccttccggatatactcttcgacttctacttattacacgtgggtcncgccgaggtccctggacgagggcctgaggtggagtgggatggccaactacccgaaaccccgagaacgtgggaccaaccaactaaagtcctgacccaaacgaagtaacggtttacgaggggtacgtacggggtaccaaccgtacgtaccggaaccccggaacggtaacctaaccggttacccaaatacctaaacgtaaccgtaaccggtaccccttaaccgtaacggtaacctaccgaaaccgtaccccgttaaacccctttaaaaacgtcccgtaaacggacccgtaacccggaaccccgggttacccttaacgttacgttaaccggtacggttacggacccggtaaggacgggttacgtaacgggttacgttaccccggttaagtttaccgggttaagttaaccgggttggtttaccgggttttcgtagtttccggttattttgggtttaacggtttaaccggggg

SEQ ID NO: 338712 - DNA, 601 bp, Homo sapiens
  misc_feature: GZ8MTXP01AQRBJ.38.27.C05.1.454.CMB.2.raw
  modified_base (221)..(221): a, c, t, g, unknown or other
  misc_feature (221)..(221): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (380)..(380): a, c, t, g, unknown or other
  misc_feature (380)..(380): n is a, c, g, or t
  modified_base (494)..(494): a, c, t, g, unknown or other
  misc_feature (494)..(494): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggttgcgtgagagcctgggcctnagtgattcgtccctgccaggcttccggatatatcttcgtcttctacttatacacgtgggtncgccaggtcccctggacaagggcctggagnggngtgggatggcataccaccagacgngacacacaagtctgcaagagaagttcgagggcaggtcacgngtacgaccgagactacgacactacaactacacgtacctacgtacggaacctacgtacaccgtaaccctaaatccgtaacgaacccgaaccgtccggtacctacttaacttccgngttacggccggaagacggacgtaacgttccgtaccgtagttaaggttagttaacggttcgttcggtttaaccgtgtttcggtttactttaagttaaggtttcccggg

SEQ ID NO: 338713 - DNA, 660 bp, Homo sapiens
  misc_feature: GZ8MTXP01ADD6N.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacactgggtgcgccaggtcccctggacagggcctggagtggatggggatgcatccaaccccagaactggacgaacacaaagtctagcaaacagtaagttcgagggcagggtcacgatcgacccgagacacgtccatacaaatacacgtcctaaccgtgaacctcaacgaccttaaccctaaaatcgtacgaaccgaccgaccgggtacccgttacttaacttaccgtaggttacggaccggaaagggacgggttaccgtaaacggttaacggtttaccccgtaacgttttacgggttaaacgttaaaggggtttcgggtttaccggggtttttaaccgtaagtttcggttaccgttttttaaggttaacgttttttcccggggg

SEQ ID NO: 338714 - DNA, 556 bp, Homo sapiens
  misc_feature: GZ8MTXP01AON3M.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagctggggcctcagtgattgtcccctgccaggcttccggatatatcttcgacttctactatacactggtgcgccaggtcccctggactaagggcctgagtggatgggatgcatcaaccccagaactggcacacaaagtctgcaacagaagtttcgagggcaggggtcacagtcgacccgagacacgtaccaatcaaatacagaccctaccgtacggaactcgatacctaccctaaaatcctagaccgaccgacgccgtactactactgtgcgaagagcagttcgtaccgtagttggttattaaggtgtaccggtttgagtcgttgttttgttaacgtttcggg

SEQ ID NO: 338715 - DNA, 705 bp, Homo sapiens
  misc_feature: GZ8MTXP01CATPF.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggtcttccggatatatcttcgacttctactatacacgtgggtgcgccgacggtccctaggacgaagggcctgagtggagtgggatgcactaccaaccccagaactggacaaccaacaaagtctacgacaaacgaagtaacggtttcgaaggggtaccgacggggtaccaacccgtaagtaccggaaccccgaacgaaccgaaccggtccaacttaccgaaacttaccacgtacccctaaccgtacggtaaacctacgaaccgtaccgttaaccccttaaaacgtccgtaacggaaccgtaaccgtaacccgggtaccttaccgttacttaaccgtgtacggccgggaaggtacgggttacggtaacgttaccgtaacgtttagggttaacgttaacggttcggttaacgggttttcgtaagttcgttcgttttaggttaacgtttcgggtaaccggggg

SEQ ID NO: 338716 - DNA, 606 bp, Homo sapiens
  misc_feature: GZ8MTXP01B1FNS.38.27.C05.1.454.CMB.2.raw
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
  modified_base (532)..(532): a, c, t, g, unknown or other
  misc_feature (532)..(532): n is a, c, g, or t
  modified_base (581)..(581): a, c, t, g, unknown or other
  misc_feature (581)..(581): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggcgcccactcccaggtagaaagttggtccagtcgtgggtttggcgtgaggaacgccgtgggggcctcgagtgtattcgtcccctgccgaggtccttcggattattactcttcgacttctacttattacagtgggtcgccgccgtaggtccctggaacgagggcctggaggtggacgtgggatcgacacgtccaaacccgtagacgtggacaaccactaaacgtctacgactaaacaaggtaacgtttcgacggggacaacggggtccaacgacgtacgacccgagaccacgtacatacgaataccgacncctacacgaactcacnccgtaactaaatcacgacgacacggccttctactcgtgcgngaagaggcagttcttacgtacgttagttacttaggtgttcggttaacgntttcgttacttggttcgtttcgggg

SEQ ID NO: 338717 - DNA, 618 bp, Homo sapiens
  misc_feature: GZ8MTXP01ASKUQ.38.27.C05.1.454.CMB.2.raw
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
  modified_base (579)..(579): a, c, t, g, unknown or other
  misc_feature (579)..(579): n is a, c, g, or t
  modified_base (602)..(602): a, c, t, g, unknown or other
  misc_feature (602)..(602): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttggcgtgaggaagccgtggggcctcagtgattcgtcccctgccaggcttccggatatatctcgacttctactattacacgtggtagcgccgaggtcccctggacgaaagggccctaggagtgggagtgggggatggcactaccgaaacccccaagaaactggacgaacccaacaaaagtctagacaaaacgaagtaaggtttccgaggggaccgaggggtaccaacccagtaccgaacccgaacgaacaccgtaccaactacaaactaaccacgaccctaaccgtaggaaacctcaagtacctaaacctaaaattcacgaacgaccgacggtcctactattactgtagngaagagnagttacgtcctagttaggttnttaaggttgtcggtttgatgttntttgttaagtttcggg

SEQ ID NO: 338718 - DNA, 590 bp, Homo sapiens
  misc_feature: GZ8MTXP01BUJZ7.38.27.C05.1.454.CMB.2.raw
  modified_base (562)..(562): a, c, t, g, unknown or other
  misc_feature (562)..(562): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcgagtgattcgtcccctgccaggtcttccggatatactcttcgacttctactattacactgggtgcgcaggtccctggacgaaggcctgagtggatgggatgcactcaaccccagaactggacaccacaagtctcgcaacagtaagttcgagggcgagggtcacagtcgacccgagacacgtccatacaactacaagccctactacggaactcgacgtacctaaccctaaatctacgaacgaccgtaccggaccttacgtacttacgtcggtcgcggtaaggacggccgtagacgttcccgtaagtttcggttattaacggtgttcgggtttaacgngttcgttacgttttgaagttttccgggg

SEQ ID NO: 338719 - DNA, 788 bp, Homo sapiens
  misc_feature: GZ8MTXP01B0L4P.38.27.C05.1.454.CMB.2.raw
  modified_base (301)..(301): a, c, t, g, unknown or other
  misc_feature (301)..(301): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtacaaaggcgcccactcccaggtagaattggtccagtcgtgggtttgcgtgaggagccgtgggcctgagtgattcgtcccctgccgtaggtccttaccgggattatacttcttcgtacttctacttattacacgtgggtcnccgccgtacggtcccctggacgaagggcctggagtgggagtgggatcgactactaccgaaaccccgagaaccgtggaccaaccgaactaaacgtcctaggacctaaaacggtaacgtaacggtttcggaaacggggtaccgtaacgggggtacccaaccgtaacggtacccgggaaccccgaacggtaaccctaaccggtacctaaacttaaccgtaaaaccgttaaccgtaccgtacccctaaaccggtacgggtaacctacccgaaaccgttaccccttaaacccgttaaaacgttccggtaacggaacccggtacccgaccggttacccgttacgttaacgttacggtacggtacggaacgggtaacggaacggttccgtaaacggttcgttaccctaagggttaaggttacgttaacgggtttaaggggtttcgttttaacgaggtttcgtttacgtttttcggttaacgtttaacccggggg

SEQ ID NO: 338720 - DNA, 643 bp, Homo sapiens
  misc_feature: GZ8MTXP01AN9Q0.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttccggatatatcttcgacttctactattacactgggtncgccaggtccctggacaagggcctgagtggagtgggatgcataccaacccagaactggacaaccaacaaagtctgactaacgagtaagtttcgagggacagggtaccacgagtaccgaccgagacacgtccaatacaatacacgtacctaccgtacgaaacctcaacgtaccgttaaccctaaaacgttcctaacggaaccgaaccgaccgggtacccgtacgttaacgttaccgtggtacgaccgggaaggacggacgtacggttacgttaccgtaacggtttaggttaacgttaagggttggttcccggttttaacgtagttcggtttccgttttcggttgttttaaccgggg

SEQ ID NO: 338721 - DNA, 644 bp, Homo sapiens
  misc_feature: GZ8MTXP01AG9QA.38.27.C05.1.454.CMB.2.raw
  modified_base (292)..(292): a, c, t, g, unknown or other
  misc_feature (292)..(292): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcgagtgattcgtcccctgccaggtcttccggatatatcttcgacttctactataccagtgggtcncgccgtacggtccccgtaggacgaacgggtccgtaggaggtggtagtgggatggcacgtacccaaaccccgagaacgtcggacgaacccaacaaagtctacgacaaaccgtaagtaacggtttacgaggggtacacggggtacacgacgtacgacccgagaaccacgtcactacaactacacgtcctacgtacgaactaccactaccggtaacctaaagtctaacgaccgaccgcccggtacgtacttacttaccgtggtcgacggaagacggcacgttacgttaccgtagttacggttagttaagtcgttcggtttaacgtcgttagttcgtttcgttaacggttccgggg

SEQ ID NO: 338722 - DNA, 637 bp, Homo sapiens
  misc_feature: GZ8MTXP01BWD86.38.27.C05.1.454.CMB.2.raw
  modified_base (168)..(168): a, c, t, g, unknown or other
  misc_feature (168)..(168): n is a, c, g, or t
  modified_base (290)..(290): a, c, t, g, unknown or other
  misc_feature (290)..(290): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggtttggcgtgaggaagccgtggggcctgagtgattcgtcccctgccaggtcttccggatatatcttcgacttctactatacacgtgggtncgccacggtccctggacaagggctgagtggatggggatggctataccaaccccagaactcggacgacaacaaagtctagcaaacgagtaagtttcgagggctacgggtccacgataccggacccgagtaccacgtacacgtacaactacgacgtacctaccgaggtaacctacgaccgtactaaccccgtaaaatccgtacgaaccgaccgtaccggacccgtttactacttaccgtcgtacgcggtaacggtacggttacacggttaacgttccgtaagttagggttaaacttaggttcgttcgtttaacggtattcggtttacgttttcgttcgttttaacgggg

SEQ ID NO: 338723 - DNA, 556 bp, Homo sapiens
  misc_feature: GZ8MTXP01AOCQA.38.27.C05.1.454.CMB.2.raw
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatacactggtgcgccaggtccctggacaagggcctgagtggagtggatgcatccaacccagaactggcgaccacaaagtctgcaacagaagtttcgaggggacgagggtcaccagtcgacccgagacacgtaccatacactacagcctacgagaactacacgaccgtacctaaactctacgaccacgaccgctactacttactagtcgagngtacgnacgttagttacctacgttgttaattaggtgttcggtttgattgttcgtttgttcgttttaacggg

SEQ ID NO: 338724 - DNA, 701 bp, Homo sapiens
  misc_feature: GZ8MTXP01DWA1F.38.27.C05.1.454.CMB.2.raw
  modified_base (229)..(229): a, c, t, g, unknown or other
  misc_feature (229)..(229): n is a, c, g, or t
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaaggagcccactcccaggtgaaattggtccagtctgggtttggcgtgaggaagcctggggcctnagtgattgccctgcagcttcggatatatctcgacttctaactattacacgtggtgcgccaggtccctggaacaaagggcctaggagtggagtgggatggacaataccaaaccccgaagaacgngggacaaccaaacaaaggttcngacaaacgaagtaagtttccgaaggggcacgggtacaaccagtcgacccgganacacgtaccaanacaaatacacacctaacgacgaaactacaagaccgttaaacccctaaaaagttctacggaaaccggaccgtaaaccggtaccccggttaaccgttagttacctagttcggaaccgggtaaacggaagggggttaccaaaggttaacccggtttacccctaaacggttttaacggggttaaaacgttaaaacgggttgggttaccgggttttttaacgaagtttccgggttacttttaaggttttaacgttttaacccggggg

SEQ ID NO: 338725 - DNA, 679 bp, Homo sapiens
  misc_feature: GZ8MTXP01APJ0J.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctgggtttgcgtgaggagccgtggggcctcagtgattcgtcccctgccaggtccttccggatatatcttcgtacttctacttattacacgtgggtgcgccgacggtccctggaccgaacgggcctggaggtggagtggggatgacacgtaccaaccccgagaacgtcggacgaacccaacgtaaacgtcgtacgactaaacgaacgtaaggtttccgaggggtacgacggggtaccaaccgtacgtaccgaaccccgaagaacccgtaccggtaccaacttaccgaaactaaccgacgtacccctaaccgtacggtaaccttacgaccgtacccttaacctaaaactcgtaacgaaccgaccgaccgtccgtactacgttacgtcgtacgacgaagacgcgagttcgttaccgtacggttgttaacgttaggttcggttcggtttaacgtagttcgttacgtttcggttcgtttaaccgggg

SEQ ID NO: 338726 - DNA, 624 bp, Homo sapiens
  misc_feature: GZ8MTXP01AL0QK.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggaagcctggggcctcgagtgattcgtcccctgccaggtcttccggatatatcttcgacttctactattacactgggtgcgccaggtcctggactagggcctgagtgagtgggatgcatccaaccccgagactggacaacccacgaaagtctacgcaaacgacgtaagtttcgaagggcgagggtcacgatcggaacccgagacctacgtacctaatacaaactacacggacccctacgtacggaactcgagtacccgtacctaaaagtctaacgaccggaccaccgggtccttactacttacgtcgtggccgaaggtcgggactaacgggcgttacccgtagtttacgggttaagttaacggtggttacggtttaacgtagttggttcgttttcgttaacgttttccgggg

SEQ ID NO: 338727 - DNA, 574 bp, Homo sapiens
  misc_feature: GZ8MTXP01EJS5J.38.27.C05.1.454.CMB.2.raw
  modified_base (168)..(168): a, c, t, g, unknown or other
  misc_feature (168)..(168): n is a, c, g, or t
  modified_base (345)..(345): a, c, t, g, unknown or other
  misc_feature (345)..(345): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggccagtctgggtttggcgtgaggagccgtggggcctcagtgattcgtcccctgccaggtccttccggatatatcttacgacttctactattacacgtgggtgcgccaggtccctggacaagggcctgagtggagtgggatgcatccaacccagacnggacgacacaaagtctgcaaacagtaagtttcgaaggggtaacggtcaccgagtcgaacccgagacacgtacatacaaactacacgtaccctaccgtagacctcgactacctaacctaaatctacgacgacaccggtccttactattctgtgcgagcgcgagtacgttaccgagttagttagttaggttggttcggtttgaattgtctttagtaagtttcggtaacggg

SEQ ID NO: 338728 - DNA, 666 bp, Homo sapiens
  misc_feature: GZ8MTXP01DH4CC.38.27.C05.1.454.CMB.2.raw
  modified_base (227)..(227): a, c, t, g, unknown or other
  misc_feature (227)..(227): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggagcgtggggcctnagtgattcgtccctgccaggtcttccggatatatcttcgacttctacttattacacgtgggtgccgcctacggtcccctaggaacgaagggcctgaggtgggagtggggatgcaactaccaaaccccagaactggacaaccaacaaagtctagacaaacaagtaacgttcgacggggtcgaagggtccaacgagtaccgacccgagaccacgtaccatacaaactaccacgtaccctaacgtacgaacctacacgtacccgttaaacccttaaaactccgtacgaaccgaccgaccgggtacccttacttacgttaccgtgtcggacggaacggtacgacgtaaacggttcgtttaacccgtagtttagggttaacttagggttccggttacggttttccgtagtttcgtttacgttttcgttaacggttttaaccggg

SEQ ID NO: 338729 - DNA, 564 bp, Homo sapiens
  misc_feature: GZ8MTXP01CMYEH.38.27.C05.1.454.CMB.2.raw
  modified_base (359)..(359): a, c, t, g, unknown or other
  misc_feature (359)..(359): n is a, c, g, or t
  modified_base (469)..(469): a, c, t, g, unknown or other
  misc_feature (469)..(469): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctgtggcctcagtgattgtccctgccaggcttccggatatatcttcgacttctactatttacactggtgcgccgaggtccctggacgaacgggcctgaggtggatgggatgcataccaaaccccagaactggacccacaanaaagtctcgaacacaagtaagtttcgaggggtacagggtcacatcgaccgacgacacgtacatacaaactacacgacctaccgtaggaacctcacggacctaccctaaancgtacgaacgaccacggtaccgtctattactgngcgaagcggtanagtactcttacgttgaagttaagtgttcggtttcgattgtctttgtaacg

SEQ ID NO: 338730 - DNA, 598 bp, Homo sapiens
  misc_feature: GZ8MTXP01D0SMI.38.27.C05.1.454.CMB.2.raw
  modified_base (228)..(228): a, c, t, g, unknown or other
  misc_feature (228)..(228): n is a, c, g, or t
  modified_base (284)..(284): a, c, t, g, unknown or other
  misc_feature (284)..(284): n is a, c, g, or t
  modified_base (522)..(522): a, c, t, g, unknown or other
  misc_feature (522)..(522): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctnagtgattgccctgcaggcttcggatatatcttcgacttctactattacactgggtnacgccaggtcccctggacgaaggcctgagtggatgggatgacatccaacccagactggcaccaacaaagtcagaccaacaagtaacgtttcgaacgggcgacgggtcaacccatacggaccccgaagaccaccggtacaactacgaaactacgaacgcctaaccgtcgaaacgtcaaccggccttaacccgtaaaatccgtacgaaaccgaccgtacggccgttactactttaccggngtcgcgaagagactagttacgttacgtacgttagttagttagttgtacgtttgtcgtcgttacgttgttcgtttgg

SEQ ID NO: 338731 - DNA, 530 bp, Homo sapiens
  misc_feature: GZ8MTXP01E5O95.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtccccttccaggcttccggatatatcttcgacttctactatttacactgggtgcgccaggtcccctggacaagggcctgagtggatgggatgcatcaaccccagaacctggcgacaccaaaagtctagcacaagaagtttcagggcagggtcaccatgacccagacacgtcatcaatacagcctactggactcagctccctaaaatctgacacacgccgtctatactgtgcgagaaggcagagttccacttggattagttgtcggtttctaagtgtctttgtaactttgtcgggg

SEQ ID NO: 338732 - DNA, 591 bp, Homo sapiens
  misc_feature: GZ8MTXP01CNEIJ.38.27.C05.1.454.CMB.2.raw
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagtcgatcacgtcacgaccggtgctcgatttagacgcgatcgaagggtttggggggagagcatcacccagcaaccacatctgtcctctagagaatcccctgagagctccgttcctcaccatggactggacctggaggatcgtcttcttggtggcagcagtcaaaggcgcccactcccaggtgaaattggtccagtcgtgggtttggcgtgaggaagccgtggggcctcagtgattcgtcccctgccaggtcttccggatatatcttcgacttctattatacagtgggtgccgcacggtccctggacaagggcctaggagtggagtggatgacacgtccaaacccagaactggaccaaccaacgaaagtctagacaactaagtaacgttcgagggcgacgggtcaacagtacgacccgagaccacgtcanactaanacacncctacgacgaactcacgactaacctaaatcacgacgaccgcggtccttactatcgtgtgcgtaacgagcgacgttcgttaccgtagttagttacttaaggttcggttaccggtttgtattcgttattttaacggttcgtttaaccgggg

SEQ ID NO: 338733 - DNA, 572 bp, Homo sapiens
  misc_feature: GZ8MTXP01A22SR.38.27.C05.1.454.CMB.2.raw
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (487)..(487): a, c, t, g, unknown or other
  misc_feature (487)..(487): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggtttgcgtgaggaagcctggggcctcagtgattgtcccctgccaggcttccggatatatcttcgacttctactattacactgggtncgccaggtccctggacagggctgagtgatggatgcatccaccccagaactggcgacctacaaagtcngcaacagtaattcagggnagggtcacntcgaccgagacacgtccagtacaatacaacgccctaccgtagtaacctactacgccttaaccctaaaacgtcctacgacgaccaaccggtccgttactagtttaaccngtcgacgaagacggcgagttacgttcgtaacgttggttattacggtgttcgggtttcgtagttcgttcgtttcgttaacgttcgg

SEQ ID NO: 338734 - DNA, 539 bp, Homo sapiens
  misc_feature: GZ8MTXP02H2BAN.38.27.C05.1.454.CMB.2.raw
  modified_base (364)..(364): a, c, t, g, unknown or other
  misc_feature (364)..(364): n is a, c, g, or t
tcagtcgatcacgtcacgaccggtgctcgatttagacgcgatcgaagggtttgggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgaccacaaagtctagcacanagtttcagggcagggtcaccatcgacccgagacacgtccatcaaatacagccctacctgaactacagacctaccctaaaatctagacaccgacggaccgtctattactgtgcgagaggcagaggttccacgttcgtataagttgtcggttttacgattgtcgttttgtatttcgg

SEQ ID NO: 338735 - DNA, 532 bp, Homo sapiens
  misc_feature: GZ8MTXP02JBQQX.38.27.C05.1.454.CMB.2.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
  modified_base (438)..(438): a, c, t, g, unknown or other
  misc_feature (438)..(438): n is a, c, g, or t
tcagtcgatcacgtcacgaccggtgctcgatttagacgcgatcgaagggtttgggagagaagagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaactgccagctccagctcctcatttatggtgcgtccacaggccacgtggcatcccagacagatcagtgcagtgcgtctgggacngacttcactctcgtgatcgacagactggacccaaacagtatttgctgtagtattactgttacaactactagtgggtacttccgggngtcgtacgttcggcctaagggaccaagggtcggaagtccaaagtcgaaacgtgtacggctacggcaccgtatacgtgtcctttcactttccccg

SEQ ID NO: 338736 - DNA, 518 bp, Homo sapiens
  misc_feature: GZ8MTXP02JX5UJ.38.27.C05.1.454.CMB.2.raw
  modified_base (223)..(223): a, c, t, g, unknown or other
  misc_feature (223)..(223): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctgggcctnagtgattgtcccctgccaggcttccggatatatcttcgacttctactatttacactgggtgcgccaggtccctggacaagggcctgagtggatggggatggcatcaaccccagaactggcgaccacaaagtctgcacagagtttcagggcagggtcaccatcgacccgagacacgtccatcaatacagcctactgaactcagctacctaaaatctagacgacacggcctctatactgtgcgagagcagacgtccacgtacgtataagtgtcggtttacgatgtctttgatttcgg

SEQ ID NO: 338737 - DNA, 527 bp, Homo sapiens
  misc_feature: GZ8MTXP02I7ZN9.38.27.C05.1.454.CMB.2.raw
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgacacaaagtctgcacagagtttcagggcagggtcaccatgacccgagacacgtccatcaatacagcctacctggaactcacgctaccctaaaatctagacacacggccgtctattactgtgcgagaggcagagttccacgttacggtataagtgtcggtttcgatggtctttgtatttcgg

SEQ ID NO: 338738 - DNA, 526 bp, Homo sapiens
  misc_feature: GZ8MTXP02IKFS0.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggattggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatgggatgcatcaaccccagaactggcgaccacaaagctgcacagagtttcaggcagggtcacatcgacccgagacacgtcatacaatacagcctactgaactcagcctacctaaatctagacgacacgccgtctacttactgtgcgagaggacagtacgtcctacgttacgtaataagtgtcggtttacgatgtctttgtatttcggg

SEQ ID NO: 338739 - DNA, 543 bp, Homo sapiens
  misc_feature: GZ8MTXP02F38VY.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctgggcctcagtgattgtcccctgccaggcttccggatatatcttcgacttctactatttacactgggtgcgccaggtcccctggacaagggcctgagtggatgggatgcatcaaccccagaactggcgaccacaaagtctgcacagagttcagggcagggtcacatcgacccgagaccacgtccatcaatacagacctacctaggaactcacgacctaccctaaaatctacgacacacggccgtctatactgtcgacgagaggcagtacgttccacgttacggtattaaggtggtcggtttacgattcgtcttttgtacgttttcgg

SEQ ID NO: 338740 - DNA, 526 bp, Homo sapiens
  misc_feature: GZ8MTXP02F90LO.38.27.C05.1.454.CMB.2.raw
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
tcagtcgatcacgtcacgaccggtgctcgatttagacgcgatcgaaggtttggggagaggcagtcaacccgagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtccctggacaagggcctgagtggatgggatgcatcaaccccngaactggcgacacaaagtcngcacagagttcagggcagggtcacatgacccgagacacgtccatcaatacagctacngaactcanctaccctaaaatctagacgacacggcctctattacngtgcgagnggcaggtactccacgttaggataagtgtcggttttcgatgtttcgtttcgttacgttcg

SEQ ID NO: 338741 - DNA, 518 bp, Homo sapiens
  misc_feature: GZ8MTXP02JCHYV.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagaactggcgaccacaaagtctgcacagagtttcagggcagggtcacatgacccgagacacgtccatcaatacagcctactggaactcagctaccctaaatctagacgacacgccgtctatactgtgcgagagcagagttccacttggtataagtgtcggtttcgatgtctttgattttcgg

SEQ ID NO: 338742 - DNA, 521 bp, Homo sapiens
  misc_feature: GZ8MTXP02ITEES.38.27.C05.1.454.CMB.2.raw
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgaccacaaagtctgcacagagtttcagggcagggtcaccatgacccgagacacgccatcaatacanccactgactcanctaccctaaaatctagacgacacgccgtactacttactgtgcgacgagcgacgagtctactacgtataagtgtcggttcgtatgttctttgtagttcg

SEQ ID NO: 338743 - DNA, 546 bp, Homo sapiens
  misc_feature: GZ8MTXP02HAHJS.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaaccccagaactggcaccacaaagtctgcacagagtttcagggcaggggtcacgatcgacccgagaccacgtcatcaatacagcctactgaactcagcctaccctaaaatcctagacgaccaacggccgtactaacttactgtagcgaggaggacagtacgtccacgttacggtattaaagtgtcggtttacgattgtcgtttagtactttcgg

SEQ ID NO: 338744 - DNA, 539 bp, Homo sapiens
  misc_feature: GZ8MTXP02ICKEU.38.27.C05.1.454.CMB.2.raw
  modified_base (288)..(288): a, c, t, g, unknown or other
  misc_feature (288)..(288): n is a, c, g, or t
  modified_base (533)..(533): a, c, t, g, unknown or other
  misc_feature (533)..(533): n is a, c, g, or t
tcagtcgatcacgtcacgaccggtgctcgatttagacgcgatcgaagggtttggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatgggatgcatcaaaccccagaaactggcgaccaacaaagtctgcacagagtttcagggcagggtcaccgatcgaccccgagaccacgtccaatcaaatacagccctacctggaactcagacctaccctaaaattcagaccgaccgaacgccgtctattactgtcgcgagaggcagacgtccacgttgtataagtgtcggtttgatgtctttagntttcgg

SEQ ID NO: 338745 - DNA, 527 bp, Homo sapiens
  misc_feature: GZ8MTXP02GZXST.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagttattgtcccctgccaggcttccggatatatcttcgacttctactattacactgggtgcgccaggtcccctggacaagggcctgagtggatgggatgcatcaaccccagaactggcgacacaaagtctgcacagaagtttcagggcagggtcaccatgacccgagacacgtcatcaatacagcctacctgaactcagcctacctaaatctagacgacaccgccgtctatactgtgcgagacgcagacgtcacttgtactaagtgtcggtttcgattgtctttgtactttcgtacgggg

SEQ ID NO: 338746 - DNA, 530 bp, Homo sapiens
  misc_feature: GZ8MTXP02JC2UA.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagttattgtcccctgccaggcttccggatatatcttcgacttctactattacactgggtncgccaggtcccctggacaagggcctgagtggatgggatgcatcaaccccagaactggcgacaccaaagtctgcacagaagttcagggcagggtcaccatcgacccgagacacgtccatcaatacagcctactgaactcagctacctaaaatctagacgacacgccgtctattactgtgcgagacggcagacgttccacgttgtataagtgtcggtttcgatcgtctttgactttcgtacgggg

SEQ ID NO: 338747 - DNA, 625 bp, Homo sapiens
  misc_feature: GZ8MTXP02JPDP5.38.27.C05.1.454.CMB.2.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgtcccctgccaggcttccggatatatcttcgacttctactatttacactgggtncgccaggtccctggacaagggcctgagtggatgggatggcatcaacccgagactggcgacacaagtcngacacagtagttcgaggcgagtcacatacgacccgagaccacgtaccatacaaactaccgacgtaccctaacgtacgaaacctaccgaaccgtacccttaaacccgtaaaactccgtaacggaacccgaaccgtaccggtacccgttacttacgttacgtacgtacgacggtaacggtacggacgtaacggtaccgttaccgtaacgttacggtaacgttaacggttcggttacggtttacgacgttcgtttacgtttacgtacgtttcgg

SEQ ID NO: 338748 - DNA, 520 bp, Homo sapiens
  misc_feature: GZ8MTXP02GUN3F.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtncgccaggtcccctggacaagggcctgagtggatgggatgcatcaaccccagaactggcaccacaaagtctgcacagagtttcagggcagggtcacatgacccgagacacgtcatcaatacagcctactcgaactcagcctacctaaaatctagacgacacggccgtctatactgtgcgagaggcagacgtccacgttcgtataagtgtcggtttcgatgtctttgtactttcgg

SEQ ID NO: 338749 - DNA, 533 bp, Homo sapiens
  misc_feature: GZ8MTXP02IO78J.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtcccctggacaagggcctgagtggatgggatgcatcaaccccagaactggcgacacaaagtctgcacagagtttcagggcaggtcacatgacccgagacacgtcatcaaatacagcctacagaactcagctaccctaaaatctagaaccgacacggccgtctattactagtgcgagaggcagtacgttccgattacggtataaggtgttcggtttacgtactgttctttagtatttcgg

SEQ ID NO: 338750 - DNA, 543 bp, Homo sapiens
  misc_feature: GZ8MTXP02GMY21.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtccccttcaggcttccggatatatcttcgacttctactattacactgggtgcgccaggtcactggacaagggcctgagtggatgggatgcatcaaccccagaactggcgaccacaaagtctgcacagagttcagggcagggtcacagtcgacccgagaccacgtcatacaatacagacctacctagaactcacgacctaccctaaaatctacgacgaccacggccgtactattactgtgacgagacgcagacttccacgttaggtataagtggtacggttttacgattgtcgttttgtacgttttcggg

SEQ ID NO: 338751 - DNA, 604 bp, Homo sapiens
  misc_feature: GZ8MTXP02JRWBQ.38.27.C05.1.454.CMB.2.raw
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctnagtgattgtcccctgccaggcttccggatatatcttcgacttctactattacactgggtncgccaggtccctggacagggcctgagtggatgggatgcatccaaccccagactggacaccacaagtctagcacagtagttcagggcagggtcacagcgaccgagacacgtacatacaatacacgccctaaccgtagaacctcacgtacctaaccctaaaatctacggaaccgaccgaccggtacccgttactacttaccgtagtcggacggtaggacggtacaacggttacgttaccctaacggtttacggtaagttaacgggttcggtttaccggttttacgtagtttcgtttaccgttttggtacgttttccggggg

SEQ ID NO: 338752 - DNA, 555 bp, Homo sapiens
  misc_feature: GZ8MTXP02G7K3C.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagaactggcgaccacagagtctgcacagaagtttcgagggcaggggtcaccatcgacccgagacacgtccatacaatacagcctacctggaaactcacgctacctaaaatctagaccgacacggccgtctacttactgtgacgagaggcaggtacgttcccgacgttggtaataacggttggtaccggttttacgagttcggttcgttttagtttacgg

SEQ ID NO: 338753 - DNA, 524 bp, Homo sapiens
  misc_feature: GZ8MTXP02JKVUB.38.27.C05.1.454.CMB.2.raw
  modified_base (227)..(227): a, c, t, g, unknown or other
  misc_feature (227)..(227): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggcttccggatatatcttcgacttctactatttacactgggtgcgccaggtccctggacaaggcctgagtggatggggatgcgacttttaaccccagaaactggcgaccacaaagtctagcacagagtttcagggcagggtcacatgacccgagacacgtccatcaatacagcctacctggaactacagctaccctaaaatctagacgacacggccgtactattaactgtgcgagagnagagtcactgtanaaagtgcggtttgatgctttgatttcgg

SEQ ID NO: 338754 - DNA, 550 bp, Homo sapiens
  misc_feature: GZ8MTXP02JM63Q.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtggaggaagcctggggcctcagtgattgtcccctgccaggcttccggatatatcttcgacttctactattacactgggtgcgccaggtccctggacaagggcctggagtggatgggatgcatcaaccccagaactggcgaccacaaagtctgcacagagttcagggcaggggtcaccgatcgacccgagacacgtcatcaatacagcctactgaactacacgacctaccctaaaatctagaaccgacgaccggtcctactacttcgtagtgacgacgaggcacgtacgtcctacgttaggtataaggtgtcggtttacgagtcgttctttagtctttacggg

SEQ ID NO: 338755 - DNA, 536 bp, Homo sapiens
  misc_feature: GZ8MTXP02INNQM.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctgggcctnagtgattgtcccctgccaggcttccggatatatcttcgacttctactatttacactgggtgcgccaggtcccctggacaagggcctgagtggatggggatgcatcaaccccagaactggcgaccacaaagtctgcacagagtttcagggcagggtcacatgacccgagacacgtcatcaaatacagcctacctgaactcacgctaccctaaaatctagaccacgacggccgtctaacttactgtgcgagaggcaggtacgttccacttcggtataagtgtcggttttacgacttgtacttttgattttcgg

SEQ ID NO: 338756 - DNA, 548 bp, Homo sapiens
  misc_feature: GZ8MTXP02IKII4.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgaccacaaagtctagcacagtagtttcgaggcgagggtcacgatcgacccgagacacgtaccatcaatacacgacctaccgtaggaacctacacgacctaccctaaaatcctacgaacgacgacggcccgtactattatgtgcgagaggcagacgttacacgttgtaatagtgtcggtttacgatgtctttgtatttacggg

SEQ ID NO: 338757 - DNA, 552 bp, Homo sapiens
  misc_feature: GZ8MTXP02JCSYA.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttcaggatatatcttcgacttctactatttacactggtgcgccaggtcccctggacagggcctgagtggatgggatgcatcaaccccagaactggccgacacaaagtctgacacagaagttcgaggggcagggtcacatcgacccgagacacgtcatacaatacacgacctacgtaggaaactcacgcctaaccctaaaactctacgaccgaccacgggtcctactattacctgtacgcggagaggacagtacgttcccacgttggtaataagtggttcgtttacgattcgttcgtttagttacg

SEQ ID NO: 338758 - DNA, 634 bp, Homo sapiens
  misc_feature: GZ8MTXP02J31GC.38.27.C05.1.454.CMB.2.raw
  modified_base (285)..(285): a, c, t, g, unknown or other
  misc_feature (285)..(285): n is a, c, g, or t
  modified_base (337)..(337): a, c, t, g, unknown or other
  misc_feature (337)..(337): n is a, c, g, or t
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
  modified_base (495)..(495): a, c, t, g, unknown or other
  misc_feature (495)..(495): n is a, c, g, or t
  modified_base (513)..(513): a, c, t, g, unknown or other
  misc_feature (513)..(513): n is a, c, g, or t
  modified_base (609)..(609): a, c, t, g, unknown or other
  misc_feature (609)..(609): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggaagcctgggcctcagtgattgtcccctgccaggcttccggattatatcttcgacttctactatttacactggtntcgccgacgtaccgtccgaggacggacggtcgtaggtaggaggtaggaggtntcgactaccgaaccccaaccgaaacgtacggacgaacccgaaccgaaagtaaccgtcgacgaactaacggtacggttaacgtacgggacggacggtacgaccaacgcgacccgaaccganacccgtaccactanactaacacgcctaacccgtagaanactcgactaccctaatancgacacgccgtacgccttattacgagtggacgacggaaggcaacgtagttaccgtactaggtttaagtaaacggttggttacccggtttcgttacngtttccgtttagttacgtttccggg

SEQ ID NO: 338759 - DNA, 560 bp, Homo sapiens
  misc_feature: GZ8MTXP02IMQLW.38.27.C05.1.454.CMB.2.raw
  modified_base (355)..(355): a, c, t, g, unknown or other
  misc_feature (355)..(355): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattcgtcccctgccaggcttccggatatatcttcgacttctactattacactgggtgcgccaggtccctggacaagggcctgagtggatgggatgcatcaaccccagaactggcacacaagtcngcacagagttcagggcagggtcacatcgacccgagacacgtcatacaatacagaccctacctaggaactcacgtacctaacccttaaaatctacgaaccgacgaccggtcctactaacttactgtagacgagaggcacgtacgttacctacgttaggtaactaaggttcgtcggttttacgatgttcgttttgtagttttacggg

SEQ ID NO: 338760 - DNA, 565 bp, Homo sapiens
  misc_feature: GZ8MTXP02IQERL.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagttattgtcccctgccaggcttccggatatatcttcgacttctactatttacactgggtncgccaggtcccctggacagggcctgagtggatgggatgcatcaacccagaactggcgacaccaaagtctgacacagtaagtttcgaggggcagggtccaccatcgacccgagaccacgtaccatacaatacacgacctaccaggaactcagcctaccctaaaatctacgacgacaccggccgtactactactgtgcgagacggcagtacgttaccacgttacggtaataagtggtcggttttacgattcgtacttttggtacttttcggtacggggg

SEQ ID NO: 338761 - DNA, 534 bp, Homo sapiens
  misc_feature: GZ8MTXP02I7BOF.38.27.C05.1.454.CMB.2.raw
  modified_base (358)..(358): a, c, t, g, unknown or other
  misc_feature (358)..(358): n is a, c, g, or t
  modified_base (430)..(430): a, c, t, g, unknown or other
  misc_feature (430)..(430): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcaccacaaagtcngcacagagtttcaggggcagggtcaccatcgacccgagaccacgtccatcaatacagcctactgaactcacncctacctaaatcctagaccgacacggcctctattactgtgcgagagcagtacgttaccacgttggtattaagtgtcggtttacgattgtactttgtactttcgg

SEQ ID NO: 338762 - DNA, 536 bp, Homo sapiens
  misc_feature: GZ8MTXP02G3XZN.38.27.C05.1.454.CMB.2.raw
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattgtcccctgccaggcttccggatatatcttcgacttctactatttacactgggtncgccaggtcccctggacaagggcctgagtggatggatgcatcaaccccanaactggcaccacaaagtctagcacagagttcagggcagggtcacgatcgaccgagaccacgtcatcaatacagcctacctggaactcacgactaccctaaaatctacgaccgacaaccggcctactatacctgtgcgagagacagtacgtacacttaggtataagtgtcggtttacgatacgtctttagtacgtttcgg

SEQ ID NO: 338763 - DNA, 557 bp, Homo sapiens
  misc_feature: GZ8MTXP02G53A3.38.27.C05.1.454.CMB.2.raw
  modified_base (355)..(355): a, c, t, g, unknown or other
  misc_feature (355)..(355): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagtctggggcctcagtgattgtcccctgccaggcttccggatatatcttcgacttctactatttacactgggtgcgccaggtccctggacaagggcctgagtggatgggatgcatcaaccccagactggcaccacaaagtcngcacagagtttcagggcagggtcacatcgacccgagaccacgtcatacaatacacgccctaccgtagaactcagacctaccctaaaatcctacgacctaccgaccggtccgtactattaccgtagtcgccgtaggacggcacgtacgttaccacgttacggtaattaaggtgtcggtttacgattgtctttgacgttttcgg

SEQ ID NO: 338764 - DNA, 542 bp, Homo sapiens
  misc_feature: GZ8MTXP02HJ6CC.38.27.C05.1.454.CMB.2.raw
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgaccacaaaagtctagcacagagtttcagggcaggggtcaccgatgacccgagacacgtccatcaatacagccacctgaactcagctaccctaaaatcctagaacgacaacggcccgtatacttaacctgtgacgagagggcagaagtttcccacttcggtaataaggtgacggttttcgatggcttttgatttcgg

SEQ ID NO: 338765 - DNA, 529 bp, Homo sapiens
  misc_feature: GZ8MTXP02GJR8K.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtccctgccaggcttccggatatatcttcgacttctactattacactgggtncgccaggtccctggacaagggcctgagtggatgggatgcatcaaccccagaactggcgaccacaaagtctgcacagagttcagggcagggtcacatcgacccgagacacgtcatcaatacagcctacgcgaactcagctaccctaaatctagacgacacgcgtactactactgtcgacgagaggcagacgttcacgttggtactaagtgttcggtttacgagttgtcgtttgtacttttcggg

SEQ ID NO: 338766 - DNA, 550 bp, Homo sapiens
  misc_feature: GZ8MTXP02GWKCY.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgccgaggtccctggacaaggcctgagtggatgggatgcatcaaccccagaactggcaaccacaaagtctagcacagagtttcagggcagggtcacgatcgaccgagacacgcatacaatacacgcctaaccgtacgaactacacgtacctaaccctaaaatctacgaccgacgaccggcctactacttactgtgcgagagacacgacttacacgttaggtactaagtgttacggtttacgagttcgtctttgtacgtttcgg

SEQ ID NO: 338767 - DNA, 537 bp, Homo sapiens
  misc_feature: GZ8MTXP02G7AJX.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgccaggtccctggacaagggcctgagtggatgggatgcatcaaccccagaactggcgaccacaaagtctgcacagagttcagggcagggtcaccatcgacccgagacacgtcatcaatacagcctactgaactcacgactaccctaaatctacgacgacacggccgtactactactgtagcgagaggcagtacgttaccacgttaggtataagtggtcggttttacgattcgtcgtttgtactttcggg

SEQ ID NO: 338768 - DNA, 526 bp, Homo sapiens
  misc_feature: GZ8MTXP02GA0SR.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctgggcctcagtgattgtcccctgccaggcttccggatatatcttcgacttctactatttacactgggtgcgccaggtcccctggacaagggcctgagtggatgggatgcatcaaccccagaactggcgaccacaaagtctgcacagagttcagggtcaggggtcacatcgacccgagacacgtcatcaatacagcctactaggaactcacgctacctaaatctagacacacgccgtctatactgtgcgtagaggcagacgttccacttcggtataagtgtcggtttacgattggtcttttgtatttcgg

SEQ ID NO: 338769 - DNA, 524 bp, Homo sapiens
  misc_feature: GZ8MTXP02JHM4V.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactattacactgggtgcgccaggtccctggacaagggcctgagtggatgggatgcatcaaccccagaactggcgaccacaaagtctgcacagagttcagggcagggtcacatcgacccgagacacgtcatcaatacagcctacctagaactcacgctaccctaaaatctacgacgacaccggccgtactacttactgtgcgagcgcagagtccacttcggtataagtgtcgtttcgattgtctttgtactttcgg

SEQ ID NO: 338770 - DNA, 573 bp, Homo sapiens
  misc_feature: GZ8MTXP02I9GEZ.38.27.C05.1.454.CMB.2.raw
  modified_base (288)..(288): a, c, t, g, unknown or other
  misc_feature (288)..(288): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttccggatatatcttcgacttctactattacactgggtnccgccacggtccctggacgaaggcctgagtggatggggatgcataccaaccccagaacctggacaccacaaagtcngacaanagtagttcgagggcaggtcacancgacccgagacacgcatacaatacacgaccctacgtagaactacacgacctaccctaaaatcctacgaaccgaccaccggcctactattactgtgacgagacggacacggtacttaccgtacgttacggtaattaacggtgttacggttttacgagttgttacttttaggtactttcggg

SEQ ID NO: 338771 - DNA, 520 bp, Homo sapiens
  misc_feature: GZ8MTXP02F6UI8.38.27.C05.1.454.CMB.2.raw
  modified_base (286)..(286): a, c, t, g, unknown or other
  misc_feature (286)..(286): n is a, c, g, or t
  modified_base (462)..(462): a, c, t, g, unknown or other
  misc_feature (462)..(462): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagcctggggcctcagtgattgtcccctgccaggcttccggatatatcttcgacttctactattacactgggtncgccaggtccctggacaagggcctgagtggatgggatgcatcaaccccagaactggcaccacaaagtctgcacagagttcagggcagggtcacatcgacccgagaccacgtcatcaatacagcctacctagaactacacgcctaccctaaatctagacgacacgccgtctactacngtgcgagagcagacgtcacgttaggtataagtgtcggtttcgatgtctttgatttcgg

SEQ ID NO: 338772 - DNA, 541 bp, Homo sapiens
  misc_feature: GZ8MTXP02ISX1P.38.27.C05.1.454.CMB.2.raw
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgacttctactattacactgggtncgccaggtccctggacagggcctgagtggatggatgcatcaaccccagaactggacaccacaaagtctagcaacagagtttcagggtcagggtcacatcgacccgagacacgtcatcaatacacgcctacctagaactcacgctaccctaaaatctagacgacgacgccgtctactactgtcgacgagagacgagtacgttcctacgttgtaagtaagtgtacggtttgacttggtactttgtactttcggg

SEQ ID NO: 338773 - DNA, 559 bp, Homo sapiens
  misc_feature: GZ8MTXP02IF4OV.38.27.C05.1.454.CMB.2.raw
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcgagtgattcgtccccttcaggcttccggatatatcttcgacttctactattacactgggtgcgccaggtcccctggacaagggcctgagtggatggatgcatcaacccagaactggcgacaccaaagtctgacanagaagtttcagggcagggtccaccatcgacccganacacgtccatcaatacacgccctaccgtacggaacctcacgtcctaaccctaaaatcctagaccgacaccggcctactacttactgtcgcgagacggacagacttaccacgttgtaacttaagtgtaacggtttcgattcgtctttgacttttcgtacgggg

SEQ ID NO: 338774 - DNA, 591 bp, Homo sapiens
  misc_feature: GZ8MTXP02IN0Z0.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgcaggtccctggacaagggcctgagtggatgggatgcatcaaccccagaactggacgaccaacaaagtctagcacagtagttcgagggcagggtcacatcgacccgagacacgtcatacaatacaacgccctaaccgtaggaaaactacacgtacctaaccctaaaatccgtacgaaccgaaccgaccggtaccgttactacttactgtacgacgacgaggacacggtacttacctacgttacggttaataaaggttggttacggtttacgtagttgttaccgttttagtacgttttcgggg

SEQ ID NO: 338775 - DNA, 547 bp, Homo sapiens
  misc_feature: GZ8MTXP02HKL1I.38.27.C05.1.454.CMB.2.raw
  modified_base (483)..(483): a, c, t, g, unknown or other
  misc_feature (483)..(483): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcctggacaagggcctgagtggatgggatgcatccaaccccagaactggacgaccaacaaagtctagacacgagtacgtttcgagggcagggtccacgatcgacccgagaccacgtcatacaactacacgcctaacctcgaactcacgacctacctaaaatctagaccgacgaccgccgtactactacngtgcgagagcagacgtacctacgttagtatagtgtcgtttacgagttgtctttgtacgtttcgg

SEQ ID NO: 338776 - DNA, 515 bp, Homo sapiens
  misc_feature: GZ8MTXP02FF20Y.38.27.C05.1.454.CMB.2.raw
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattgttccagtctggttggcgtgaggaagcctggggcctcagtgattgtcccctgccaggcttccggatatatcttcgacttctactatttacactgggtgcgccaggtcccctggacaagggcctgagtggatgggatgcatcaaaccccagaactggcgacacaaaagtctgcacagagttcaggcagggtcacatgacccgagacacgtccatcaatacagcctacctgaactcagctaccctaaaatctagacgaccacggccgtctattacngtgcgagagcagngtcacttagtataagtgtacgtttcgatgctttgatttcgg

SEQ ID NO: 338777 - DNA, 532 bp, Homo sapiens
  misc_feature: GZ8MTXP02HJN0N.38.27.C05.1.454.CMB.2.raw
  modified_base (431)..(431): a, c, t, g, unknown or other
  misc_feature (431)..(431): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtgcgccaggtccctggacaaggcctgagtggatggatgcatcaaccccagaactggcgaccacaaagtctagcacagagttcagggtcagggtcacatcgacccgagaccacgtcatcaatacacgacctacctagaacctacgacncctaccctaaatctagacgacacgccgtctattactgtgcgagagcagacgttccacgttagtataagtgtcggtttacgtctagttctttgtactttcgg

SEQ ID NO: 338778 - DNA, 534 bp, Homo sapiens
  misc_feature: GZ8MTXP02JOYPU.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagaactggcgaccacaaagtctgcacagagtttcaggggcaggggtcaccatgacccgagacacgtccatcaatacagcctactgaactcagctaccctaaaatctagaccgacacggccgtctacttactgtgcgagaggcagtacgttccacgttgtactaagtgtcggttttacgatgtcgttttgtattttcgg

SEQ ID NO: 338779 - DNA, 543 bp, Homo sapiens
  misc_feature: GZ8MTXP02JSI1Y.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctggggcctcagtgattgtccccttcaggcttccggatatatcttcgacttctactattacactgggtgcgccaggtcccctggacaagggcctgagtggatgggatgcatccaacccagaactggcgacaccaaagtctgcacagaagttcgagggcagggtcacagtcgacccgagaccacgtccatacaaatacacgacctaccgtagacctcagacctaacccgtaaatctacgacgaccacggcctactatactgtgcgagacgcagtacgtccagttacgtataagtgtcggtttcgatcgtctttagtacgttcgtacgggg

SEQ ID NO: 338780 - DNA, 534 bp, Homo sapiens
  misc_feature: GZ8MTXP02I8JMJ.38.27.C05.1.454.CMB.2.raw
  modified_base (463)..(463): a, c, t, g, unknown or other
  misc_feature (463)..(463): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtccctggacaagggcctgagtggatgggatgcatcaaccccagactggcgacacaaagtctgcacagagtttcagggcaggggtcacgatcgacccgagacacgtcatcaatacagccctacctggaactcagctaccctaaaatctgacacacggcctctatactgtncgagaggcagtacggttcctacgttggtattaaagtgtccggttttagacttggttctttgtattttcggg

SEQ ID NO: 338781 - DNA, 529 bp, Homo sapiens
  misc_feature: GZ8MTXP02JNMYG.38.27.C05.1.454.CMB.2.raw
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattgtcccctgccaggcttccggatatatcttcgacttctactatttacactgggtncgccaggtccctggacaagggcctgagtggatgggatgcatcaaccccagaactggcgaccacaaagtcngcacagagttcagggcagggtcacatcgacccgagacacgtcatcaatacagcctactgaacctcacgctaccctaaaatcgtagaccgacgacgccgtactattactgtgcgtagaggcacgacgttccacgttacgtatagtgtacggtttcgatgtctttgactttcgg

SEQ ID NO: 338782 - DNA, 557 bp, Homo sapiens
  misc_feature: GZ8MTXP02HN9KE.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagttattgtcccctgccaggcttccggatatatcttcgacttctactatttacactgggtgcgccaggtccctggacaagggcctgagtggatgggatgcatcaacccagaactggcgacacaaagtctgcacagaagtttcgagggcagggtcacagtgacccgagacacgtcatcaaatacacgacctaccgtacggaactcacgcctaccctaaaactctacgaccgacaccggccgtactattactgtcgacgagacggcaggacgttccacgttagtacttaaggtgtcggttttcgagttcgtcgtttgtacgtttcgtcgggg

SEQ ID NO: 338783 - DNA, 534 bp, Homo sapiens
  misc_feature: GZ8MTXP02HEB8F.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtgcgccaggtccctggacaagggcctgagtggatgggatgcatcaaccccagaactggcgaccacaaagtctgcacagagtttcaggggcagggtcacatcgacccgagacacgtcatcaatacagccctacgtgaactcagacctaccctaaatctagacgacaccggcgtactatactgtcgcgacgaggcagacgttacacgttaggtactaaggtgtcggtttacgagttgtctttagactttcgg

SEQ ID NO: 338784 - DNA, 536 bp, Homo sapiens
  misc_feature: GZ8MTXP02IQARF.38.27.C05.1.454.CMB.2.raw
  modified_base (530)..(530): a, c, t, g, unknown or other
  misc_feature (530)..(530): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgaccacaaagtctgcacagagttcagggcagggtcacatcgacccgagacacgtcatcaatacagccctactggaactcacgactaccctaaaatcctagaaccgacaccggcgtctattactgtgcgagaggcagtacgttccacttaggtattaagtgtcggttttcgatggttctttagtntttcgg

SEQ ID NO: 338785 - DNA, 524 bp, Homo sapiens
  misc_feature: GZ8MTXP02HKSYX.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagaactggcgaccacaaagtctgcacagagtttcagggcagggtcacatcgacccgagacacgtcatcaatacagcctacctgaactcagctaccctaaaatctagacgacacgccgtctattactgtgcgagacggcacgagtccacttcggtaataagtgtcggtttcgatgtctttgtatttcgg

SEQ ID NO: 338786 - DNA, 526 bp, Homo sapiens
  misc_feature: GZ8MTXP02GALKY.38.27.C05.1.454.CMB.2.raw
  modified_base (336)..(336): a, c, t, g, unknown or other
  misc_feature (336)..(336): n is a, c, g, or t
  modified_base (515)..(515): a, c, t, g, unknown or other
  misc_feature (515)..(515): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctgggcctcagtgattgtcccctgccaggcttccggatatatcttcgacttctactatttacactgggtgcgccaggtccctggacaagggcctgagtggatgggatgcatccaaaccccngaactggcaccacaaagtctgcacagagttcagggcagggtcacatcgacccgagacacgtcatcaatacagcctacctgaactcagcctaccctaaaatctagaccgacgacggtccgtactattactagtgcgaggagacaggtacgtcacgttagtataagtgtcggtttgacttncgtcttgttag

SEQ ID NO: 338787 - DNA, 554 bp, Homo sapiens
  misc_feature: GZ8MTXP02I7T7T.38.27.C05.1.454.CMB.2.raw
  modified_base (385)..(385): a, c, t, g, unknown or other
  misc_feature (385)..(385): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgacacaaagtctgcacagagttcaggggcagggtcaacntcgacccgagaccacgtccatcaatacacgcctacctaggaacctcacgtcctaccctaaatcctagaccgacacgccgtactattacagtgcgagaggacagaacgttccacgttaggtaattaacggtgtaccggttttacgattcgttacttttggtattttcggg

SEQ ID NO: 338788 - DNA, 561 bp, Homo sapiens
  misc_feature: GZ8MTXP02HUQNR.38.27.C05.1.454.CMB.2.raw
  modified_base (387)..(387): a, c, t, g, unknown or other
  misc_feature (387)..(387): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatccaaccccagaactggacgaccacaaagtctagcacagagtttcagggcagggtcacntacgacccgagacacgtcatacaatacacgcctacctagaactcacgaccttaaccctaaaatcctagaccgaacgaccggaccgtactacttacgtgtacgcgacggaggacagtacgttaccacgttcggtaataaggtgttcgtttacgagttgtcttttgtacttttcgg

SEQ ID NO: 338789 - DNA, 576 bp, Homo sapiens
  misc_feature: GZ8MTXP02GSSQ9.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtcccctggacaaggcctgagtggatggatgcatcaaccccagaactggcgaccacaaagtctgcacagagttcagggcagggtcacatacgacccgagacacgtccatcaaataccacgtacctacctaggaacctacacgcctaccctaaaatcctagaccgaccgacggtaccgtctattacctgtacgacggagacggcaacggtacgttacctacgttaggtaacttaacggtcgtcggttttaccgagttcgttaccgttttagtacttttccgggg

SEQ ID NO: 338790 - DNA, 570 bp, Homo sapiens
  misc_feature: GZ8MTXP02GXM35.38.27.C05.1.454.CMB.2.raw
  modified_base (361)..(361): a, c, t, g, unknown or other
  misc_feature (361)..(361): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtgcgccaggtccctggacaagggcctgagtggatgggatgcatccaaccccagaactggcgaccacaaagtctgcanagtagttcagggcagggtcacgatcgacccgagaccacgtcatcaatacacgcctaccgtagaactacacgtacctaccctaaaatctacgaccacgaccggaccgtactacttacgtgtacgacgagacggcaggtacgttacctacgttacggtaataaggtcggttacggttttacgattggttccttttaggtacttttccgggg

SEQ ID NO: 338791 - DNA, 529 bp, Homo sapiens
  misc_feature: GZ8MTXP02JUK8L.38.27.C05.1.454.CMB.2.raw
  modified_base (418)..(418): a, c, t, g, unknown or other
  misc_feature (418)..(418): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatcaaccccagaactggcgaccacaaagtctgcacagagtttcagggtcagggtcacatcgacccgagacacgtccatcaatacagcctacngaactacagcaccctaaaatctagacgacacgccgtctacttactgtagcgagaggcacgagttccacgttggtaataaggtgtcggtttcgatggtactttgtatttcgg

SEQ ID NO: 338792 - DNA, 525 bp, Homo sapiens
  misc_feature: GZ8MTXP02F66R7.38.27.C05.1.454.CMB.2.raw
  modified_base (285)..(285): a, c, t, g, unknown or other
  misc_feature (285)..(285): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactattacactgggtncgccaggtccctggacaagggcctgagtggatgggatgcatcaaaccccagaactggcgaccacaaagtctagcacagagttcagggcgagggtcacatcgacccgagacacgtcatcaatacagcctactagactcagctacctaaatctagacgacacggcgtctattactgtgacgagagacacgagttaccacgttacgtataagtgtcggtttcgactgtctttagtactttcgg

SEQ ID NO: 338793 - DNA, 523 bp, Homo sapiens
  misc_feature: GZ8MTXP02JIOYN.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtgcgcaggtccctggacaagggcctgagtggatgggatgcatcaaccccagaactggcaccacaaagtctgcacagagttcagggtcagggtcacatgacccgagacacgtcatcaatacagcctactggaacctcagctaccctaaatctagacgacacgcgtcgtattactgtgcgtagaggcacgagttccacgttcggtataagtgtcggttttcgagtgtacgtttgatttcgg

SEQ ID NO: 338794 - DNA, 554 bp, Homo sapiens
  misc_feature: GZ8MTXP02JCKE2.38.27.C05.1.454.CMB.2.raw
  modified_base (203)..(203): a, c, t, g, unknown or other
  misc_feature (203)..(203): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaacctggccaggctcccaggctcctcatttatggtgcgtccaccaggccactggcatcccagacagattcagtggcagtgcgtcgtgggcagacttcactctcgtgactcgacagactcggacccaacagtatttgcttgtgtattactgtcaactactagtcgggtcttccgggcgtggtacgtttcggaccgaaagggaccgaagggtacggaaacgtcgaaacgtacggaaaccttggtacggcttaggcctaaccacgttctgttccttctactttccccg

SEQ ID NO: 338795 - DNA, 513 bp, Homo sapiens
  misc_feature: GZ8MTXP02FUBNP.38.27.C05.1.454.CMB.2.raw
  modified_base (430)..(430): a, c, t, g, unknown or other
  misc_feature (430)..(430): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagcctgggttggcgtgaggaagcctggggcctcagtgattgtcccctgccaggcttccggatatatcttcgacttctactattacactgggtgcgccaggtccctggacaagggcctgagtggatgggatgcatccaaaccccagaactggcgaccacaaagtctgcacagagttcagggcagggtcacgatcgacccgagacacgtccatcaatacagacctaccagaactcgacnctaccctaaatctagacgacacggccgtctatctgtgacgagagcagatcacgtgatagtgtcgtttcatgtctttgatttcg

SEQ ID NO: 338796 - DNA, 604 bp, Homo sapiens
  misc_feature: GZ8MTXP02IZR4L.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtcccctggacaaggcctgagtggatgggatgcatccaaaccccagaacctggacgacccacaaacgtctcgcaacagtagtttcgaggggcagggtcacagcgacccgagacacgtcactacaataccacacctaccgtacggaactaccacgtacctaccctaaaatccgtacggaccgaaccgaccggtccgttacttacttacgttagtcgacggaacgacggactaacggtacgttacctacgtttaggtaacgttaaggtcggttacggttttcgtagttgtttcgttttgttacgttttcgggg

SEQ ID NO: 338797 - DNA, 567 bp, Homo sapiens
  misc_feature: GZ8MTXP02H1TRI.38.27.C05.1.454.CMB.2.raw
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggaagcctgggggcctcagtgattcgtcccctgccaggcttccggatatattcttcgacttctactatttacactgggtncgcaggtcctggacaaggcctgagtggagtggatgcatcaaccagaactggacaccacgaaagtcngacacagagtttcgaggcagggtacacgatacgacccgagacacgtccaancaatacacgacctacctagaactcacgactacctaaaatcacgacgacaccgacgttactacttacgtgtcgacgagacgacgacgtacgttaccgtacgttaggtaagtaacggttcgtccggtttacgacgttgttaccgtttgttactttccgggg

SEQ ID NO: 338798 - DNA, 593 bp, Homo sapiens
  misc_feature: GZ8MTXP02F0D2O.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtgcgccaggtccctggacaagggcctgagtggatgggatgcatcaaccccagacgtggcgaccacaaagtctgcacagagttcagggcagggtcacatcgacccgagacacgtaccatacaatacacgtccctacgtacgaactaccgagacctaaccctaaatcctacgacgaccgacggaccgtactacttacgtagtcgaccgtaaggacggacaaggtacgttccgtaacgtttacggtaagttaaacggtcggttaccgggttttacgtacgttcggtttcgttttagtacgtttttaccgggg

SEQ ID NO: 338799 - DNA, 610 bp, Homo sapiens
  misc_feature: GZ8MTXP02FW0YN.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggccttccggatatatcttcgacttctactattacactgggtgcgccaggtccctggacaagggcctgagtggatgggatgcatccaaaccccagaactggcaaccacaaagtctgcacagagtttcgagggtcaggggtcaaccgatcgacccgagaccacgtccatacaaatacaagccctaaccgtagaactacacgtacctaaccctaaaatctacgacgaaccgaccggaccgtacttaacttacgtagtcgacgaaggacggacacggtaacgttacccgtaacgtttacgggtaagttaaaggttcggttacgggtttttacgacgtttggtttccgtttttaggtacgtttttccgggg

SEQ ID NO: 338800 - DNA, 564 bp, Homo sapiens
  misc_feature: GZ8MTXP02JHTTU.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacagggcctggagtggatgggatgcatcaacccagactggcaccacaagtctgcacagagttcagggcagggtcacatcgacccgagaccacgtccatacaaataccagccctacctagaacctcacgcctaccctaaaatcctacgaaccgaccgaccggccgtactacttactgtagcgaagaggaccagtacgttacacgtttacggtaataaggtggttacggtttacgtagttcgttcttttaggtcgttttacggg

SEQ ID NO: 338801 - DNA, 569 bp, Homo sapiens
  misc_feature: GZ8MTXP02H96Z2.38.27.C05.1.454.CMB.2.raw
  modified_base (290)..(290): a, c, t, g, unknown or other
  misc_feature (290)..(290): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (496)..(496): a, c, t, g, unknown or other
  misc_feature (496)..(496): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggaagcctggggcctcgagtgattcgtcccctgccaggcttccggatatatcttcgacttctactattacacgtgggtncgccaggtcccgtaggacgaagggcctggacgtggaagtgggatggacactccaaaccccagaacgtcggacaacccgaacaaacgtcagacaacgagtagtttcgaggcgaggtcaccancacccgagaccacgtcaanacaaatacacgacctaccgtagaactcacgtacctaacctaaatcagaccgacaccgctctattcngtagcgagacgcagtactcctacgttacgtataagtgttacggtttcagttcgtttacgtttgtacgtttcgg

SEQ ID NO: 338802 - DNA, 519 bp, Homo sapiens
  misc_feature: GZ8MTXP02HCWA3.38.27.C05.1.454.CMB.2.raw
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggctttggcgtgaggaagcctggggcctcagtgattgtcccctgccaggcttccggatatatcttcgacttctactattacactggtgcgccaggtcccctggacaagggcctgagtggatggggatgcatcaaaccccngaaactggccgacacaaaagtctgcacngaagtttcagggcagggtcaccatgaccgagacacgtcatcaatacagcctactcgaactcagctacctaaaatctagacgacacgccgtactattactgtgcgagagcagacgtccacttgtataagtgtacgtttcgatcgtctttgtacg

SEQ ID NO: 338803 - DNA, 630 bp, Homo sapiens
  misc_feature: GZ8MTXP02H6Z2O.38.27.C05.1.454.CMB.2.raw
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggaagccgtggggcctcagtgattcgtccctgccaggcttccggatatatcttcgacttctactatttacactgggtncgccaggtccctggacaagggcctgagtggagtggatgcatcaaaccccagaactcggacaaccaacgaaaagtctaggacaacgagtacgtttcgaagggtccgaggggtaccaaccgagtcgaacccgagacgacgtaccaatacaaatacacgccctaaccgtacgaactcacgtacctacctaaaatcacgaacgacgacggaccgtacttacttacgtcgtagaccgtaggacggacgaacgtacgttaccctaacgtttacggtaaacttaagggttcggttaccggtttacgtagttcggttttaccgttttaggtttacgttttaaccggggg

SEQ ID NO: 338804 - DNA, 564 bp, Homo sapiens
  misc_feature: GZ8MTXP02IHH63.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctgggcctnagtgattgtcccctgccaggcttccggatatatcttcgacttctactatttacactgggtgcgccaggtccctggacaagggcctgagtggatggatgcatcaaccccagactggcaccacaaagtctgcacagagtttcgagggtcgagggtccacatcgacccgagacacgtccatcaatacacgtcctacctgaacctcacgacctaaccctaaaatcgtagaaccgaccgaccggaccgtactaacttctgtacgcgaggaggacagtacgttaccctacgttacgttattaaggtgttcggttttacgattcgtcgttttgtaacttttcgggg

SEQ ID NO: 338805 - DNA, 568 bp, Homo sapiens
  misc_feature: GZ8MTXP02IJQ76.38.27.C05.1.454.CMB.2.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagctggggcctnagtgattgtcccctgccaggccttccggatatatcttcgacttctactatttacactgggtncgccaggtcctggacaagggcctgagtggatgggatgcatccaacccagaactggcaccacaaagtctgacacagagtttcagggcagggtcacatcgaccgagacacgtacatacaatacagaccctacgacgaactacacgtcctaccgtaaaatctagaaccgacgaccggtaccgtactacttactgtacgtacggacgaggcaagtacgttacctacgttacggtaataaggttcgttacggtttacgtacgttgttcttttagtacgttttacggg

SEQ ID NO: 338806 - DNA, 653 bp, Homo sapiens
  misc_feature: GZ8MTXP02JJYSG.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccgaggtagtaaagtttcggtaccagtcgttggggtttcggcgtggaaggaacgtccggtggggccctcgagtgtagtttccgtcccctgaccgaggtccttaccggattatactcttacgtacttctacttacttactacgtggggtcgccgaccgtaccggtccgtaggaacgaacgggcctaggaggtggagtgggatggactacgtacccaaaccccgagaaccgtcggaccaacccgaactaaacgtctagacaacgagtacgttcgagggctagggtaccacagtcgacccgagaccacgacatacaatacacgtacctaccgtagacctacacgtacctaaacctaaatcgtacgaaccgaccgaccggtccttacttacttacgagtcgacggaggacgacgagtacgttacctagttacggtaataaggttgtacggtttacagtctttcgtttagtcgtttacgggg

SEQ ID NO: 338807 - DNA, 539 bp, Homo sapiens
  misc_feature: GZ8MTXP02H9XO7.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggagcctgggcctcagtgattgtcccctgccaggctttccggatatatcttcgacttctactatttacactgggtncgccaggtccctggacaagggcctgagtggatgggatgcagtcaaaccccagaaactggacgaccaacaaagtctgcacagagtttcgaaggcgaggtcaccatcgacccgagacacgtccatcaatacagccctaccgactcagcctaccctaaaattcacgacgacgacgaccgtctattacgtgtgacgagagacaggactccacttcggataagtgtcgtttcgattgtcttttgactttcgacgggg

SEQ ID NO: 338808 - DNA, 592 bp, Homo sapiens
  misc_feature: GZ8MTXP02GRZE7.38.27.C05.1.454.CMB.2.raw
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (455)..(455): a, c, t, g, unknown or other
  misc_feature (455)..(455): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctcccaggctcctcatttatggtgcgtccaccgagggccactggccactcccagacagattcagtgcagtgcgtcgnggggcagacttcactctgtgatcganagactcggacccaanagtatttgcttgtgtattactgtcaactacgttagtcggggttacttcccgggngttcggtaccggtttcgggaccgtaaaacggggacccgtaaaaggggtacggaaacggtacgaaacgtaccggaaacttcggtacggtcgttcggaacctaccggaacttccgtggttcctttacaacgtttccccg

SEQ ID NO: 338809 - DNA, 585 bp, Homo sapiens
  misc_feature: GZ8MTXP02G1CXM.38.27.C05.1.454.CMB.2.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggancagctacttagcctggtaccagacaaaacctggccaggctcccaggcctcctcatttatggtgcgtccaccgagggccactggcactcccagacagattcagtggcagtgcgtcgtgggacagacttcactctcgtgactcgacagtactcggaacccaacgagtacttttgacttgtgttattactgtacaactactagttcgggttcttccgggcgttaggtacgttcgggaccgtaaaggggacccgaaagggtaggaaagtacgtaaacgtacggaaacgttggtacggtctacggaaccgacctaacttcgtcgttacctttcgaactttcccccg

SEQ ID NO: 338810 - DNA, 548 bp, Homo sapiens
  misc_feature: GZ8MTXP02IC9O2.38.27.C05.1.454.CMB.2.raw
  modified_base (226)..(226): a, c, t, g, unknown or other
  misc_feature (226)..(226): n is a, c, g, or t
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggcttccggatatatcttcgtacttctactatttacactgggtncgccaggtccctggacaagagcctgagtggatggggatgcatcaaccccagaactggccgaacacaaagtctagcacagaagtttcagggacagggtcacatcgaccgagacacgtacatacaactacacgccctactagaactcacgacctacctaaaactctagacgacgacgccgtacttactactgtcgcgagacggacacgtacgtaccacgtttggtaataaggtcgtacggtttcgagttgttcgtttgttag

SEQ ID NO: 338811 - DNA, 591 bp, Homo sapiens
  misc_feature: GZ8MTXP02FXMUU.38.27.C05.1.454.CMB.2.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctactattacactgggtncgccaggtccctggacaaggcctgagtggatgggactgcatccaaaccccagaactggacgaaccaacaaagtcngacaacaagtagttcaggggcgacgggtcaaccgatacgacccgagaccacgtacatacaaatacaacgcctaccgtagaactcaacgcctaaccctaaaatcctagaaccgaaccgacggtacctacttaacttacgtagtacgacgaggacggacaggtacgttacctacgtttaggtaattaaggtcgttcggtttacgacgttgttacgtttcgtaagtttcggg

SEQ ID NO: 338812 - DNA, 579 bp, Homo sapiens
  misc_feature: GZ8MTXP02GOC17.38.27.C05.1.454.CMB.2.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggcttccggatatatcttcgacttctactatttacactgggtncgccaggtccctggacaagggcctgagtggatgggatgcatcaaccccagaactggcaccacaaagtctgcacagagtttcgagggcagggtcaccatcgacccgagacacgtcatacaatacacgacctacctaggaacctacacgactaccctaaaatctacgacgaaccacggccgtactacttactgtcgcgaggtacggactagtacgttccgaacgttcggtaagttaacggttggtaccgggtttttacgacgttggttaccgtttttggtactttttccgggg

SEQ ID NO: 338813 - DNA, 596 bp, Homo sapiens
  misc_feature: GZ8MTXP02G6CME.38.27.C05.1.454.CMB.2.raw
  modified_base (289)..(289): a, c, t, g, unknown or other
  misc_feature (289)..(289): n is a, c, g, or t
  modified_base (358)..(359): a, c, t, g, unknown or other
  misc_feature (358)..(359): n is a, c, g, or t
  modified_base (362)..(362): a, c, t, g, unknown or other
  misc_feature (362)..(362): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggccttccggatatatcttcgacttctactatttacactgggtncgccaggtcctggacaagggcctggagtggatgggatgcatccaaccccagactggacaccacaagtcnncanagagttcgaggcgaggtcacatcgaccgagacacgtcatacaaataccacgacctaaccgtacggaacctcgaacgtacctaaccctaaaatccgtacgaaccgaccgaccggtccgttactaacttactagtcggacgaaggacgagacgtacgttacccacgtttacggtaattaacggttcggttacggttttacgagtttcgttacgtttttacggtacgttttccgggg

SEQ ID NO: 338814 - DNA, 631 bp, Homo sapiens
  misc_feature: GZ8MTXP02GLZMU.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggccttccggatatatcttcgacttctactattacactgggtgcgcacggtcctggacagggcctgagtggatgggatggcatcaaccccagaactggcaccacaaagtctgacacagtacgtttcaggggtcaggggtccacgagtacgaacccgagaccaccgtaccactaccaaactacacgtaccctaccgtacggaaacctacacgacctaaccctaaactctacggaacacccgaacggccctacttacttacgtacgtcgaccggaaggacgggacgacggtaacggttaccgttacggttacggttaagttaaacgggttcggtttaccggggttttacgtagttcggtttaccgttttggttacgttttaccggggg

SEQ ID NO: 338815 - DNA, 542 bp, Homo sapiens
  misc_feature: GZ8MTXP02I6IFV.38.27.C05.1.454.CMB.2.raw
  modified_base (323)..(323): a, c, t, g, unknown or other
  misc_feature (323)..(323): n is a, c, g, or t
  modified_base (414)..(414): a, c, t, g, unknown or other
  misc_feature (414)..(414): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagctggggcctcagtgattgtcccctgccaggcttccggatatatcttcgacttctactatttacactgggtgcgccaggtcccctggacaagggcctgagtggatgggangcatcaaccccagactggacgacacaaagtctgcacagagttcagggtcagggtcacatcgaccgagacacgtcatcaatacacgcctacngaactcagacctacctaaatctagaccgacacggcgtactattcagtcgtcgagagggcagtacgttaccacgttaggtaactaagtggtacggttttacggattcgttacttttgtacgttttacgg

SEQ ID NO: 338816 - DNA, 632 bp, Homo sapiens
  misc_feature: GZ8MTXP02JD1B0.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggcctcgagtgattcgtcccctgccaggcttccggatatatcttcgacttctactattacactgggtncgccaggtccctggacagggcctgagtggagtgggatgacataccaaaccccgagaactggacgaaccaacaaagtctagacaacgagtagtttcgaaggggccgaggggtaccaaccgtagtacgaacccgagaaccaccgtaccaatacaaataccgacgtaccctaacctacgaactacgaacgtacctaaccctaaaatcctacgaaccaaccgaccggtacctactacttaccgtgtagaccggaaggacggacgtaacggtacgttacccgtaacgttacggtaattaaggttcgttacggttttacgagttcgttacgtttttagtacgttttcggg

SEQ ID NO: 338817 - DNA, 592 bp, Homo sapiens
  misc_feature: GZ8MTXP02GLLGD.38.27.C05.1.454.CMB.2.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattcgtccccttcaggcttccggatatatcttcgacttctactatttacactgggtncgccaggtccctggacaagggctgagtggatgggatggcatcaaccccagaactggacgacaaccaaagtctgacacagaagttcgagggcagggtcaccatcgaccgagacacgtcatcaaatacacgacctactacgaactcacgacctaacctaaaactcgtacgaacgacgaacccgggtcctacttacttacctggtacgcgaggacggcgaggtacgttaccgacgtttacggtaattaacggttcgtaacggtttacgtagttcgttacgttttaggtacgtttcggttaccggggg

SEQ ID NO: 338818 - DNA, 621 bp, Homo sapiens
  misc_feature: GZ8MTXP02IXRQ0.38.27.C05.1.454.CMB.2.raw
  modified_base (289)..(289): a, c, t, g, unknown or other
  misc_feature (289)..(289): n is a, c, g, or t
  modified_base (395)..(395): a, c, t, g, unknown or other
  misc_feature (395)..(395): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggcttccggatatatcttcgacttctactattacactgggtncgccaggtccctggacaggcctgagtggatgggatgcataccaacccgagaactggacaaccacaaagtcagacaacagtagtttcagtcggacagggtccaacgntaccgacccgagaccgacgtccaagtacaactacgacgtaccctaccgtagtaacctacgtacgtacctaaccctaaaatccgtacgaaccgtaccgaccggtaccgttactaacgttaccgtcggtacggtacgtacggacggactaacggtacgttaccgtaacgttaggtaacgttaacggttcggtaccggttttacgagttacgtttcgttttagttacgg

SEQ ID NO: 338819 - DNA, 559 bp, Homo sapiens
  misc_feature: GZ8MTXP02HZCGY.38.27.C05.1.454.CMB.2.raw
  modified_base (287)..(287): a, c, t, g, unknown or other
  misc_feature (287)..(287): n is a, c, g, or t
  modified_base (356)..(356): a, c, t, g, unknown or other
  misc_feature (356)..(356): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgccaggtccctggacaagggcctgagtggatgggatgcatcaaccccagaactggcgacacaaagtcngcacagagttcgagggcagggtcaccatcgacccgagacacgtccatcaaactacacgcctacctggaacctcagacctacctaaaatctacgacgacaccggacctactattacctgtcgacgaggaggacacgtacgttccgtacgttacggtaattaggtcggtcggtttacgattcgttacgttttagtacgtttcggg

SEQ ID NO: 338820 - DNA, 552 bp, Homo sapiens
  misc_feature: GZ8MTXP02HV4FS.38.27.C05.1.454.CMB.2.raw
  modified_base (287)..(287): a, c, t, g, unknown or other
  misc_feature (287)..(287): n is a, c, g, or t
  modified_base (426)..(426): a, c, t, g, unknown or other
  misc_feature (426)..(426): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattgtcccctgccaggcttccggatatatcttcgacttctactatttacactgggtncgccaggtccctggacaagggcctgagtggatgggatggcagtcaaccccagaactggcgaccacaaagtctgcacagagtttcgaggcaggggtacaccatcgacccgagacacgtccatacaatacacgcctaaccnggaactcacgctacctaaaatctacgacgacgacgccgtacgtactacgtgtgcgagaggcacgacggttaccacgttcggtaattaagtgttacggtttacgagttgtcgttttgtactttcggg

SEQ ID NO: 338821 - DNA, 537 bp, Homo sapiens
  misc_feature: GZ8MTXP02F4WLM.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctacttattacactgggtgcgccaggtccctggacaagggcctgagtggatgggatgcatcaaccccagaactggacacacaaagtctgacacagtagtttcgagggtcgagggtcaacgatcgacccgagacacgtccatcaatacagcctacagactcacgctacctaaatctacgacgacacgaccgtctactactgtcgcgagacgacagtacgtacacgttacgtagtaagtggtcgtttacgacttgtactttgagtttcgg

SEQ ID NO: 338822 - DNA, 575 bp, Homo sapiens
  misc_feature: GZ8MTXP02HNPXN.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcagtcaaccccagaactggacgacacaaagtctgcacagagtttcagggcagggtcacatcgacccgagacacgtcatacgaaatacacgacctaaccgtaggaacctcgacgtaccttaaccctaaaatccgtagaacgaaccgaccgaccgtactacttacgtagtgcgtagacggcaagacgttcctacgttaggtaacgtaagtgtccggttttagtacgttacgttcgtttgttacgttttcggg

SEQ ID NO: 338823 - DNA, 580 bp, Homo sapiens
  misc_feature: GZ8MTXP02JAS44.38.27.C05.1.454.CMB.2.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccacctctcctgcagggccagtcagactattaggagcagctacttagcctggtacagcaaaacngccaggctccagctcctcatttatggtgcgtccacgacggccacgtcggcactcccagaccagattcagtgcagtgcgtcgtgggcagcttcactctcgtgactcgacagactaggaacccaacgagtattttgcttacgtagttatttacgtgttacaaactacttagttacgggtcgttccggcgttacgtaccggtttcggaccgtaaaggggacccgaagggttacggaaacgttacaaacgttacggaaacgtggtacggtcgtacgctaaccgtattccgtacgttaccttctacgtttcccg

SEQ ID NO: 338824 - DNA, 659 bp, Homo sapiens
  misc_feature: GZ8MTXP02HEESL.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtccctgccaggcttccggatatatcttcgacttctactatttacacgtgggtncgccaggtccctaggacgaaggcctggagtggatggggatggacataccaaacccccgaagaaccgtgggacaaccaacgaaaagtcgtagacaacgaagtacggtttcgaagggggctagggggtaccaacgagtaccgaacccgacgaaccgaccgtacccatacaaactaccaacgtccctaaccgtagaaacctacgactacctaaccccttaaaatccgtacggaaccgaaccgaccgggtaccttacttaacttaccgtaggtcgacggtaagaggacgacggtacgttaccgtacgttaggttaacttaaggttcggtaccggttttacgacgttgtttaaccgttttgtaacgttttccgggg

SEQ ID NO: 338825 - DNA, 574 bp, Homo sapiens
  misc_feature: GZ8MTXP02HFBMR.38.27.C05.1.454.CMB.2.raw
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctactatttacactgggtgcgccaggtcctggacaagggcctgagtggatgggatgcatcaacccagaactggcaccacaaagtctgcacagtagttcgagggcagggtcacatcgacccganaccacgcanacaatacacacctacctagaacctcacgactacctaaaatctacgacgacgaccggtcctactacttacgtagtcgcgtacggacggctaacggacgttaccgaacgttacggtaacgttaaggtcgttacgggtttacgtagttggttacttttaggttacgttttccgggg

SEQ ID NO: 338826 - DNA, 575 bp, Homo sapiens
  misc_feature: GZ8MTXP02IQXMV.38.27.C05.1.454.CMB.2.raw
  modified_base (288)..(288): a, c, t, g, unknown or other
  misc_feature (288)..(288): n is a, c, g, or t
  modified_base (495)..(495): a, c, t, g, unknown or other
  misc_feature (495)..(495): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgcaggtcccctggacaaggcctgagtggagtgggatgcatccaaaccccagacctggaccgaccacaaagtctagcaacagagtttcgagggcagggtcacatcgacccgagacacgtcatacaataccagaccctactcgaactcagtcctaaccttaaatctagaaccacgaccgaccgtactattactgtcgacggagacggngaacgtacgttacctaccgttaggtaacgtaaagttcggtcggttttacgtacgttgttccgttttagttagtttccggg

SEQ ID NO: 338827 - DNA, 556 bp, Homo sapiens
  misc_feature: GZ8MTXP02JKWNC.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggcctcagtgattgtcccctgccaggcttccggatatatcttcgacttctactatttacactgggtgcgccaggtcccctggacaaggcctgagtggatggatgcatcaaccccagaactggacgaccacaaagtcagcacagagtttcagggcgagggtcacgatcgaacccgagaccacgtccatcaaataccacgacctacctaggaactacacgacctaccctaaaatctagaccgacgacggccgtactattactgtgcgagagcacgtacgttcctacgttacggtataaggtcggtcggtttacgacgttgttctttgtacttttcggg

SEQ ID NO: 338828 - DNA, 523 bp, Homo sapiens
  misc_feature: GZ8MTXP02FOPUR.38.27.C05.1.454.CMB.2.raw
tcagtcgatcacgtcacgaccggtgctcgatttagacgcgatcgaaggggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcgaccacaaagctgcacagagttcagggtcagggtcaccatcgacccgagacacgtcatcatacagcctactagactacacgctaccctaaaatctagacgacacggcgtctattactgtgcgagagcagagttcacgttgtataagtgtcggtttcgagttgtctttgatttcggg

SEQ ID NO: 338829 - DNA, 646 bp, Homo sapiens
  misc_feature: GZ8MTXP02GF3ZI.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggcctcagtgattgtcccctgccaggcttccggatatatcttcgacttctactatttacactgggtncgccaggtccctggacaagggcctgagtggatggggatgcatccaaccccagaactggacaccacaaagtctgacaacagtagttcgagggacagggtccacagtacgacccgagaccacgtacagtacaatacagccctacgtagaacctcaacgtacctaaccctaaattccgtacgaaaccgacctaaccgggtcccgttaacttaacgtttaccgtagtacggacggaacggacgggtaccgaaacgggttaacgttacccgtaacgttttaagggtaacgtttaaaacgggttggttaccgggtttttacggaatttcggtttcgtttttaacggtaacgttttttaccggggg

SEQ ID NO: 338830 - DNA, 587 bp, Homo sapiens
  misc_feature: GZ8MTXP02I92LP.38.27.C05.1.454.CMB.2.raw
  modified_base (360)..(360): a, c, t, g, unknown or other
  misc_feature (360)..(360): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatccaacccagactggcaccacaaagtctgcanagagtttcagggcagggtcacgatcgacccgagacacgtaccatacaataccacgtccctaaccacggaacctacacgtacctaaccctaaaatcctacgaaccgaccgaccggaccgttactacttacctgtgaccgaggacggacacggtacgttacccgtacgttacggtaataaggttcggtacggttttacgacgttgttaccgttttgtacgttttccggg

SEQ ID NO: 338831 - DNA, 631 bp, Homo sapiens
  misc_feature: GZ8MTXP02G8WXB.38.27.C05.1.454.CMB.2.raw
  modified_base (224)..(224): a, c, t, g, unknown or other
  misc_feature (224)..(224): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctgggcctnagtgattgtcccctgccaggcttccggatatatcttcgacttctactattacacgtgggtcgcgccacggtccctggacgagggcctgagtggatgggatgcatccaaccccagactggacgaccacaaagtcagcacagtagttcgagggcaggtcaacgatcgaacccgagaccacgtacactacaataccacgtccctaaccgtagaacctacgacgtaccctaacccttaaatcctaacgaccgaaccgaccggtcccgttacttaacgttaccgtagtacgacggtaaggacggacgaacggtacgttaccctaacggtttaggttaacgtttaaacgggttcggtttacgggtttttaccgtaagtttccggtttacgtttttaggaacgtttttccgggg

SEQ ID NO: 338832 - DNA, 577 bp, Homo sapiens
  misc_feature: GZ8MTXP02GQYZ0.38.27.C05.1.454.CMB.2.raw
  modified_base (384)..(384): a, c, t, g, unknown or other
  misc_feature (384)..(384): n is a, c, g, or t
  modified_base (473)..(473): a, c, t, g, unknown or other
  misc_feature (473)..(473): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatggggatgcatcaaccccagaactggcaccacaaagtctgcacagagttcagggcagggtcacancgaccgagacacgtccatcaatacacgcctacctagaactcacgacctacctaaaatcgtacgacgaccaccggccgtactacttacgngtacgcgaaggacggacaacggtacggttacctaccgttaggtaacgttaaggtaacgttcggttttacgtagttcgtacgtttttcggtacgtttttccgggg

SEQ ID NO: 338833 - DNA, 551 bp, Homo sapiens
  misc_feature: GZ8MTXP02FTCU0.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagaactggcgacacaaagtctagcacagagttcagggcagggtcacgatgacccgagaccacgtcatcaaatacagcctacctaggaacctcaagcctaaccctaaaatctacgacgaccacgggcctacttacttactgtcgcgaagaggcagtacgttactacgttacggtaattaaggtgttccggttttacgacttgtctttgattttcgg

SEQ ID NO: 338834 - DNA, 550 bp, Homo sapiens
  misc_feature: GZ8MTXP02H3135.38.27.C05.1.454.CMB.2.raw
  modified_base (226)..(226): a, c, t, g, unknown or other
  misc_feature (226)..(226): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattcgtcccctgccaggcttccggatatatcttcgacttctactatttacactgggtgcgccaggtccctggacaagggcctgagtggatgggatgcatcaaccccagactggcaccacaaagtcngacanagagttcagggcagggtcacatcgacccgagacacgtcancaaatacanacctacctgaactcagcctaacctaaatcctagaccgacacggaccgttatacttactgtcgacgtacgaggcaagtacgttacctacgttaggtaactagttcggtcggttttacgattcgtctttagtacgtttcggg

SEQ ID NO: 338835 - DNA, 512 bp, Homo sapiens
  misc_feature: GZ8MTXP02JMPSO.38.27.C05.1.454.CMB.2.raw
  modified_base (289)..(289): a, c, t, g, unknown or other
  misc_feature (289)..(289): n is a, c, g, or t
  modified_base (460)..(460): a, c, t, g, unknown or other
  misc_feature (460)..(460): n is a, c, g, or t
  modified_base (508)..(508): a, c, t, g, unknown or other
  misc_feature (508)..(508): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatgggatgcatcaacccagaactggcacacaaagtctgcacagagtttcagggtcagggtcacatcgacccgagacacgccatcaatacagcctactgaactcagctaccctaaatctagacacacggccgtctacttacngtgcgagagcagacgtcacgttgtatagtgtcgtttcgactgctcttntacg

SEQ ID NO: 338836 - DNA, 609 bp, Homo sapiens
  misc_feature: GZ8MTXP02HDGB0.38.27.C05.1.454.CMB.2.raw
  modified_base (357)..(357): a, c, t, g, unknown or other
  misc_feature (357)..(357): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagctggggcctcagtgattgtcccctgccaggcttccggatatatcttcgacttctactattacactgggtgcgccacggtccctggacgaagggcctggagtggagtgggatgcatccaaccccagactggacaccacaagtcngcacagtagttcgaggggcaggtccacgagtccgaacccgagaccgacgtaccatacaatacacaccctactagactcacgtacctaccctaaatcctacgaacgaccgaccggtaccgtacttaacttacgtacggtacgacggaaggtacggacgtacggtaccgttaccgtacgtttacggtaacgttaaggttccggtttacggttttacgtacgtttgtttaccgtttttagttacgttttccgggg

SEQ ID NO: 338837 - DNA, 551 bp, Homo sapiens
  misc_feature: GZ8MTXP02HLYZR.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtncgccaggtccctggacaagggcctgagtggatgggatgcatcaacccagaactggcacacaaagtctgcacagagttcgagggcagggtcacatcgacccgagacacgtaccatacaatacacgacctacctaggaacctcacgtacctaccctaaaatctacgacgacgacggcctacgtacttactgtcgcgagacggacacgacgttaccacgttacgtaagttagtgtcggtttacgagttgtctttagtacgtttcggg

SEQ ID NO: 338838 - DNA, 584 bp, Homo sapiens
  misc_feature: GZ8MTXP02JQXY0.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcagtgattcgtcccctgccaggcttccggatatatcttcgacttctactatttacactgggtgcgccaggtccctggacagggcctgagtggatgggatgcatcaaccccagaactggacgaccacaagtctagcacagtagtttcagggcgaggtccacatcgacccgagacacgtcatcaatacacgaccctactacggaactcgacgtacctaacccgtaaaactctacgaaccgtaccgaccggtaccgtacgtacttaactggtacgacgacggacggacacggtacgttacctacgttaggttagttaacgtggttaccggttttgtacgttcgttcgttttgtagtttccggg

SEQ ID NO: 338839 - DNA, 591 bp, Homo sapiens
  misc_feature: GZ8MTXP02GXJYI.38.27.C05.1.454.CMB.2.raw
  modified_base (228)..(228): a, c, t, g, unknown or other
  misc_feature (228)..(228): n is a, c, g, or t
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctnagtgattgtcccctgccaggcttccggatatatcttcgacttctactattacactgggtncgccaggtccctggacaggcctgagtggatgggatgcatccaaccccagaactggacgaccaacaaagtctgacacagtagtttcgagggcgagggtcacgatcgaacccgagaccacgccatcaaatacacaccctaaccgtacggaactacgacgtacctaaccctaaaatcctagaaccgacgaccggaccgtatacttactacgtgaccggaggaggacacggtacgttacccgtacgttaggtaacttaaggtcgttacgggttttacgagttcgttcgttttcgtacgtttttcggg

SEQ ID NO: 338840 - DNA, 573 bp, Homo sapiens
  misc_feature: GZ8MTXP02IAZDF.38.27.C05.1.454.CMB.2.raw
  modified_base (286)..(286): a, c, t, g, unknown or other
  misc_feature (286)..(286): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggagcctggggcctcagtgattgtccctgccaggcttccggatatatcttcgacttctactatttacactgggtnccgccaggtcccctggacaagggcctgagtggagtgggatgcatccaaccccgagaacgtggacacccacaaagtcngacaanagtagttcgaggcgagggtacaccgatcgacccgagaccacgtccaatcaaatacacgtccctaacgtacgaactacgactaccctaacctaaaatcgtacgaaccgacgaaccggtccgtactacgttactgtacgacgagacggcaacgtacgtacctacgtaggtataagtgttcgtttacatcgttctttagtcgttcgg

SEQ ID NO: 338841 - DNA, 543 bp, Homo sapiens
  misc_feature: GZ8MTXP02HTVAB.38.27.C05.1.454.CMB.2.raw
  modified_base (287)..(287): a, c, t, g, unknown or other
  misc_feature (287)..(287): n is a, c, g, or t
  modified_base (487)..(487): a, c, t, g, unknown or other
  misc_feature (487)..(487): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtncgccaggtccctggacaagggcctgagtggatgggatgcatcaaccccagaactggacgacacaaagtctagcacagagtttcagggtcgacggggtacaccatcgacccgagaccacgtccatacaaactacaagcctaccgtacgaactcacgcctaacctaaatctagaccacacggctactatactgtgcgagagnagacgtctacgttgtagtaagtgtcggtttacgagtcgttcgtttacgtgtttcgg

SEQ ID NO: 338842 - DNA, 555 bp, Homo sapiens
  misc_feature: GZ8MTXP02HLQ6O.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatccaaccccagaactggcgaccacaaagtctgcacagagtttcaggcagggtcacatcgacccgagacacgtcatcaactacacgaccctacctacggaactacacgaccttaccctaaaatcctacgaaccgacaccggccgtactacttactgtcgacgaggacgacgagacgttacaccgttacgtaagtagtgttcggttacgtattggtctttgtactttcgg

SEQ ID NO: 338843 - DNA, 598 bp, Homo sapiens
  misc_feature: GZ8MTXP02HYOUG.38.27.C05.1.454.CMB.2.raw
  modified_base (319)..(319): a, c, t, g, unknown or other
  misc_feature (319)..(319): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactggtgcgccaggtccctggacaagggcctgagtggangggatgcatcaacccagactggacacacaaagtcagcacgagtacgtttcgaggggtcaggggtccaaccataccggacccgagaccgacgtaccaatacaaataccacgaccctaaccgtggaacctacacgtacctaacccttaaaatcctagaaccgtaccgaccgggtccgttactaacgttacctggtacgtcgaacgaggaccacggtagttacccacgtttacggtaataaggttcgtcggttttacgattagtacttttaggtactttcgg

SEQ ID NO: 338844 - DNA, 581 bp, Homo sapiens
  misc_feature: GZ8MTXP02HYNPP.38.27.C05.1.454.CMB.2.raw
  modified_base (227)..(227): a, c, t, g, unknown or other
  misc_feature (227)..(227): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggcttccggatatatcttcgacttctactatttacacgtgggtcgcgccacggtccctggacgaagggcctgagtggagtgggatgcatccaacccagaacgtggcgaccaacaaagtcagcanagagtttcgaggcagggtcacgancgaccgagacacgtccacacaatacacgacctacctaggaactcacgtacctacctaaatcacgaccgacgaccgcgtactacttacgtgtacgacggagtacggacacggtacgttccgtacgttaggttaataacggttcggttcggttttacgtagttcgtttacgtttaggttacgtttcgggg

SEQ ID NO: 338845 - DNA, 524 bp, Homo sapiens
  misc_feature: GZ8MTXP02IRRLH.38.27.C05.1.454.CMB.2.raw
  modified_base (226)..(226): a, c, t, g, unknown or other
  misc_feature (226)..(226): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggcttccggatatatcttcgacttctactatttacactgggtgcgccaggtccctggacaagggcctgagtggatgggatgcatcaaccccagaactggcgacacaaagtctgcacagagtttcagggcagggtcacatcgaccgagacacgtccatcaatacagcctacctgaactcacgctaccctaaatctgaccgacacggcgtctattctgtgcgtagaggcagtacgtctacgttcgtaataacgtgtcggtttcgatgtcttttgtatttcgg

SEQ ID NO: 338846 - DNA, 591 bp, Homo sapiens
  misc_feature: GZ8MTXP02HO7I1.38.27.C05.1.454.CMB.2.raw
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggttggcgtgaggagcctggggcctcagtgattgtcccctgccaggcttccggatatatcttcgacttctactatttacactgggtgcgccaggtccctggacaagggcctgagtggatgggatgcatcaaccccagactggcgacccacaaagtctgacacagtacgtttcgagggcaggggtcaacgagtcgacccgagacgacgtcatacaatacacgcctacacgaactcacgaccttacccgtaaatcctagaccgacgaccggtccgtactacttacgtgtcgacgaggaggacaacggtacgttacccgttacgttacggtaagttaacggtcggttacggttttacgtagttcggtttacttttggtttaagttttccggggg

SEQ ID NO: 338847 - DNA, 580 bp, Homo sapiens
  misc_feature: GZ8MTXP02FJL4B.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgtcccctgccaggcttccggatatatcttcgacttctacttattacactgggtgcgccaggtccctggacaagggcctgagtggatgggatgcatccaaccccagactggcgaccacaaagtctagcacagtagttcgagggcagggtcacatcgacccgagaccacgtcatcaatacagccctactagaactacacgacctaccctaaaatcgtacgaaccgaccgaccggccgttactacttaacgtgtcgacggacggaggacgtacgtacgttacccacgtttaggtaacttaaggttcgttacgggtttttacgagttcgttcttttaggtacgttttccggg

SEQ ID NO: 338848 - DNA, 602 bp, Homo sapiens
  misc_feature: GZ8MTXP02JR5JF.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtccctggacaagggcctgagtggatgggatgcatcaaccccagaactggacaaccacaaagtctgcacagtacgtttcgagggcagggtcacgatcgacccgagaccacgtacatacaatacacgaccctacctacgaacctacgacgacctaacccctaaaatccgtacgaaccgaccgaccggtaccgttaccttacgttacctaggtcgacggtaggacggtcaacggttacgttaccgtacgtttacggtaattaaggtcggttacggttttacgagttcgttacttttaggtacgttttcggg

SEQ ID NO: 338849 - DNA, 680 bp, Homo sapiens
  misc_feature: GZ8MTXP02GMXID.38.27.C05.1.454.CMB.2.raw
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctacttatttacacgtgggtncgccaggtcccctggacaacgggcctgagtggatggggatggcatccaaccccagaactggcaaccacaaagtctagcacagtagtttcgagggtcaggggtaccacagtcgaacccgagaccaccgtaccactacaactacacgtacccgtaccgtacggaacctaccgacgtacccttaaccctaaaacttccgtaacggaacccgtaacccgaccggggtacccttacgttaacgtttacccgtaggttcgacgggtaaggacgggaccgtaagggttaccggtttacccgtaaccggtttagggttaaacgttaaacggtttcgggttaccgggtttttaccgtaaggtttcggtttaccgtttttagtttaacgtttttccggggg

SEQ ID NO: 338850 - DNA, 540 bp, Homo sapiens
  misc_feature: GZ8MTXP02JCN61.38.27.C05.1.454.CMB.2.raw
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (392)..(392): a, c, t, g, unknown or other
  misc_feature (392)..(392): n is a, c, g, or t
  modified_base (464)..(464): a, c, t, g, unknown or other
  misc_feature (464)..(464): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctgggcctcagtgattgtcccctgccaggtcttcggatatatcttcgacttctactatttacactggggtgcgccaggtccctggacaagggcctgngtggatgggatgcatcaaccccngactggcgaccacaagtcngcaccagagtttcaggggcagggtcacatcgacccgngacacgtcatcaatacagcctacgtggaactcagcctaccctaaaatctagacgacacgccgtctacttacngtcgtcgagacggcaggtacgttccacgttacgtataacgtgtaccggttttcgagtcgttctttagattttcggg

SEQ ID NO: 338851 - DNA, 663 bp, Homo sapiens
  misc_feature: GZ8MTXP02F5CTS.38.27.C05.1.454.CMB.2.raw
  modified_base (289)..(289): a, c, t, g, unknown or other
  misc_feature (289)..(289): n is a, c, g, or t
  modified_base (359)..(359): a, c, t, g, unknown or other
  misc_feature (359)..(359): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcttgggttggcgtgaggaagccgtggggcctcagtgattcgtcccctgccaggcttccggatatatcttcgacttctactattacactgggtncgccaggtcccctggacaagggcctgagtggatgggatgcatcaaccccagactggacaccacaaagtcngacacagtagttcaggggcagggtcacagtacgaccgagacacgtaccatacaatacacgtaccctaccgtacggaactacgacgtacctaacccttaaaactccgttaacggaaccgaacccgaacccggggtacccttacgttaaactttaccgtagttcgggacggtaacgggacggtaccggtaaacggtaccgtttacccgaaccggttttacggtaagtttaaacgggtaacggtttaccgggttttaccggtaaagttcggttttaccgttttagggttacgtttttaacccggggg

SEQ ID NO: 338852 - DNA, 572 bp, Homo sapiens
  misc_feature: GZ8MTXP02F7PIX.38.27.C05.1.454.CMB.2.raw
  modified_base (359)..(359): a, c, t, g, unknown or other
  misc_feature (359)..(359): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctacttattacactgggtgcgccaggtcccctggacaagggcctgagtggatgggatgcatcaaaccccagaactggcgacacaaagtcngcacagagtttcgagggacagggtcaacatcgaacccgagacacgtaccagtacaaactacacgccctaccgtaggaaactaccagacctaccctaaaatcctagaacgaccacggccgtactacttactgtagcgaggaggacgagtacgttacctacgttaggtaacttaagtggttcggtttacgtagttcgtctttagtagttttccgg

SEQ ID NO: 338853 - DNA, 707 bp, Homo sapiens
  misc_feature: GZ8MTXP02FYJIJ.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagcctggggcctcgagtgattcgtcccctgccaggtcttccggatatatcttcgacttctacttattacacgtgggtgcgccgaggtcccctggaccgaagggcctaggacgtgggatgggatggcactaccaaaccccgagaaaccgtggacgaacccaacaaagtctacgacaacgaagtagttcgaggggtacgacggggtccaacgataccgaacccgagaaccgaccgttaccgaataaccaaaactaccgaacgtaccccttaaccgtacggtaacctaccggtaaccacccttaaaccccgtaaaatccgtaacggaaccgaacccgaccggggtacccttacgttacgtttaacgtcggtacgggaccgacgggtacggaccgtaacggttaccgtttaaccgaacgtttacgggttaacgttaaaggttcggtttcgggttttaccgtaggtttcgttcgtttttacggtacgtttttaccgggg

SEQ ID NO: 338854 - DNA, 600 bp, Homo sapiens
  misc_feature: GZ8MTXP02I3LTD.38.27.C05.1.454.CMB.2.raw
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctnagtgattgtcccctgccaggccttccggatatatcttcgacttctactatttacacgtgggtnccgccaggtcccctggacaagggcctgagtggagtgggatgcatccaaaccccagaacctggaccgacacaaagtctgacagtagtacgttcgagggtacgacgggtcaacgagtaccgaacccgagaccacgtaccatacaaactacacgtacctaccgtacgactacacgtacctaacctaatcctacggaaccaccgacggtctacttattctagtgacgagacgtacgacggtacttaccgtagttacgtaagttaggtcggttacggtttacgagttccgtttacgtttagttacgtttcgggg

SEQ ID NO: 338855 - DNA, 529 bp, Homo sapiens
  misc_feature: GZ8MTXP02IBM12.38.27.C05.1.454.CMB.2.raw
  modified_base (361)..(361): a, c, t, g, unknown or other
  misc_feature (361)..(361): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatggcatcaaccccagaactggcgaccacaaagtctgnacagagtttcagggcagggtcaccatgacccgagacacgtccatcaatacagcctacctgaactcagctccctaaaactctgacgacacggccgtctacttactgtcgcgagaggcaggagttccacttaggtataagtgtcggttttcgattgcttttgtatttcgg

SEQ ID NO: 338856 - DNA, 564 bp, Homo sapiens
  misc_feature: GZ8MTXP02IB1GX.38.27.C05.1.454.CMB.2.raw
  modified_base (435)..(435): a, c, t, g, unknown or other
  misc_feature (435)..(435): n is a, c, g, or t
tcagtcgatcacgtcacgaccggtgctcgatttagacgcgatcgaagggtttgggggagagcatcacccagcaacccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagttattgtcccctgccaggcttccggatatatcttcgacttctactattacactgggtgcgccaggtccctggacgaagggcctggagtggatggggatgcatccaacccagaactggacgacaccaaagtctagcacagaagtttcgagggcaggggtaccaccgagtcgaacccgagaccacgtccatacaatacacgctacngactcagctacccaaatctagacacacgccgtctatactgtgcgagtacgacagacgttccaacgttacgtagttagtaggttcggttttacgacgttgttccgttttagtacgttttcggtaccgggg

SEQ ID NO: 338857 - DNA, 548 bp, Homo sapiens
  misc_feature: GZ8MTXP02JZ95Y.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggagcctggggcctcagtgattgtcccctgccaggcttccggatatatcttcgacttctactatttacactgggtncgccaggtccctggacaagggcctgagtggatgggatgcatccaaaccccagaactggacgaaccacaaagtctagcacagtagttcgagggcagggtcacatcgacccgagacacgtcatacaatacagcctactacgaactcacgctaccctaaaatctagacgacgacggccgtactacttacgtgtagcgacgaggacacgacgttccagtttcggtataagtcggtcggttttacgagttgtcttttgagtttcgg

SEQ ID NO: 338858 - DNA, 554 bp, Homo sapiens
  misc_feature: GZ8MTXP02FWJ6D.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtncgccaggtccctggacaagggcctgagtggatgggatgcatcaaaccccagaactggcgacacaaagtctgcacagagttcagggcagggtcaacatcgacccgagacacgtcatacaaatacagcctactacgaactcacgactaccctaaaatctagaaccgacacggccgtactactactgtgcgagaggctacgacgttaccgacgttacggtaagttaaaggtgtacggttttacgagtgttcttttacggtattttccggg

SEQ ID NO: 338859 - DNA, 546 bp, Homo sapiens
  misc_feature: GZ8MTXP02HG8HF.38.27.C05.1.454.CMB.2.raw
  modified_base (288)..(288): a, c, t, g, unknown or other
  misc_feature (288)..(288): n is a, c, g, or t
  modified_base (419)..(419): a, c, t, g, unknown or other
  misc_feature (419)..(419): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagtccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatgggatgcatcaaccccagaactggcgaccacaaagtctagcacagagtttcagggcaggggtcacatcgaccgagacacgtcatcaatacagcctaccngaactcacgctacctaaaatctagacacgacgccgtactatactgtcgacgtaggacgcgacgtagtcctacgttacggtaactaaggtgtacggtttacgagttcgtacttttgtacgtttccggg

SEQ ID NO: 338860 - DNA, 665 bp, Homo sapiens
  misc_feature: GZ8MTXP02HEWZQ.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactggtncgccaggtccctggacaagggcctggagtggatggggatgcactaccaacccgagacgtggacaaccaacgaagtcacgacaacgaagtacgttacgagggacgtacggtaccaacgtagtacccggaacccgagaacccgtaccgtacctaataacctaaactaccgaaccgtaccctaacgtacgaacctacgacctaccctaaacccttaaatccgtacgaaaccgaccgaccggtacccgtttactaacgtttaccgtgtacgaccggtaaggacgacgtaacgtaccgttacccgtacgttacgggtaaagttacggtcggtttaccgggtttacgtagtttcgtttaccgttttaggttacgtttcccggggg

SEQ ID NO: 338861 - DNA, 612 bp, Homo sapiens
  misc_feature: GZ8MTXP02HMPLT.38.27.C05.1.454.CMB.2.raw
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatccaaaccccagaactggacaccaacaaagtctgcacagagtttcgagggcaggtcacagtcgaccganaccacgtcanacatacagccctaacgtaggactacacgtacctaccctaaaatcctacggaaccgaaccgacggtaccgtacttacttacgtgtacgcggtaacgacggtacgaacggttacgttacccgtacgtttacgggtaagttaaaacggttcggttacgggtttttaccgagtttacggttccgtttttaggtaacgtttttccggggg

SEQ ID NO: 338862 - DNA, 630 bp, Homo sapiens
  misc_feature: GZ8MTXP02GQ764.38.27.C05.1.454.CMB.2.raw
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctacttattacacgtgggtcncgccaggtccctaggacaaggcctgagtggatgggatgcatccaacccagaactggacaccacaaagtcagacacgaagtacgttcgaggggcgacgggtccaacgagtaccggaacccgagaccgacgtaccatacaactaccacgtaccctacgtacgaacctacgacgtacctaaccctaaatctacgacgaccgacggtacctataacgttcgtgtacgaccggaaggacggacgtaacggttaccgttacctacggtttacggtaacgttaaggggttcggtttacccgggttttacgagtttcggtttacgttttaggttacgttttaccggggg

SEQ ID NO: 338863 - DNA, 569 bp, Homo sapiens
  misc_feature: GZ8MTXP02JDFVB.38.27.C05.1.454.CMB.2.raw
  modified_base (401)..(401): a, c, t, g, unknown or other
  misc_feature (401)..(401): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagactggcaccacaagtctagcacagtagtttcagggcaggtcacatcgacccgagacacgtcancaactacacgacctaccgagaactcacgtcctaccctaaatctacgacacacggcctactactactgtacgacgtagacgtacgacgtacgttacctacgtttacggtaattaaacggtcggtacgggttttacgtagttcgttaccgttttgtaacgtttttccggg

SEQ ID NO: 338864 - DNA, 552 bp, Homo sapiens
  misc_feature: GZ8MTXP02INAQ7.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtcccctggacaagggcctgagtggatggatgcatcaaccccagaactggcaccacaaagtctagcacagagtttcaggggcaggggtccacagtcgacccgagacacgtcatacaatacagacctactgaactcacgcctaaccctaaaatctacgaacgaccgacggccgtactattactgtgacgagacggcagtacgttccacgttaggtattaaggtgtcggttttacgagtttgtcttttagtacttttcggg

SEQ ID NO: 338865 - DNA, 533 bp, Homo sapiens
  misc_feature: GZ8MTXP02GAIIF.38.27.C05.1.454.CMB.2.raw
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattgtcccctgccaggcttccggatatatcttcgacttctactatttacactgggtgcgccaggtccctggacaagggcctgagtggatgggatgcatcaaaccccagaactggcgaccacaaagtctgcacagagttcagggcagggtcacatgacccgagacacgtccatcaaatacagccctacctaggaactcacgcctacccctaaaaatcctagaccgacaccggtccgtactattactgtgcgagaggcagagttccacttggtataagtgtcggtttcgattgtctttgatttcgg

SEQ ID NO: 338866 - DNA, 599 bp, Homo sapiens
  misc_feature: GZ8MTXP02J2ORG.38.27.C05.1.454.CMB.2.raw
  modified_base (289)..(289): a, c, t, g, unknown or other
  misc_feature (289)..(289): n is a, c, g, or t
  modified_base (489)..(489): a, c, t, g, unknown or other
  misc_feature (489)..(489): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagccgtggggcctcagtgattcgtcccctgccaggcttccggatatatcttcgacttctactatttacactgggtncgcaggtccctggacaaggggcctgagtggagtgggatgcatccaaccccagaactggacaccacaagtctgcacagtagttcgagggcaggtcacatcgacccgagaccacgtaccatacaactaccagtccctaaccgttacgaactcacgtaccttacctaaaatctacgaccacgaccggtccgtactacgttacngtacggacgaggacggacaacggtacgttacctaacgttaggttaacgttaacgggttcggttaccgggtttttacgagtttcgtttaccgttttagtacgtttccgggg

SEQ ID NO: 338867 - DNA, 624 bp, Homo sapiens
  misc_feature: GZ8MTXP02F5R3S.38.27.C05.1.454.CMB.2.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
  modified_base (423)..(423): a, c, t, g, unknown or other
  misc_feature (423)..(423): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaanccggtggggcctnagtgattgtcccctgccaggcttccggatatatcttcgacttctactattacactgggtncgccaggtcctggacaaggcctgagtgatggatgcatcaaaccccagaactggacaacacaaagtctgacacaagagtttcgaggggcacgggtcaaccagtacgacccgagaccacgtacatacaaatacacncctaaccacggaactacgacgacctaaccctaaaatcctagaaccgtaaccgacggacccgttacttaacttacgtacgtacgacggaaggacggacgtaacggaaccggtttaccgaaccgtttacgggttaattaaacgggtcggttaccggtttttacgaaggtttcgttaccgtttttaggtactttttcccggggg

SEQ ID NO: 338868 - DNA, 621 bp, Homo sapiens
  misc_feature: GZ8MTXP02GVZ58.38.27.C05.1.454.CMB.2.raw
  modified_base (291)..(291): a, c, t, g, unknown or other
  misc_feature (291)..(291): n is a, c, g, or t
  modified_base (426)..(426): a, c, t, g, unknown or other
  misc_feature (426)..(426): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcgagtgattcgtcccctgccaggcttccggatatatcttcgacttctacttattacactgggtncgccaggtccctggacaagggcctggagtggatgggatgcactaccaaccccagactggacgaaccacaaagtctgcaacagtacgttcagggcagggtccacagtcgaccgagacacgtccatacaaagacacnccctaacgtgaacttacgacgtacctaaccctaaattccacgtaacccgaacgaccgggtaccttacgtaacttacgtcgtacggacgaacgggacgacgaacggttacgttacccgtacgtttaggtaacttaaacgggtggtttaccgggtttacgaggtttcgttaccgtttttaggtacgtttttacgggg

SEQ ID NO: 338869 - DNA, 577 bp, Homo sapiens
  misc_feature: GZ8MTXP02JSP7P.38.27.C05.1.454.CMB.2.raw
  modified_base (288)..(288): a, c, t, g, unknown or other
  misc_feature (288)..(288): n is a, c, g, or t
  modified_base (428)..(428): a, c, t, g, unknown or other
  misc_feature (428)..(428): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttccggatatatcttcgacttctactattacactgggtncgccaggtcctgacaaggcctggagtggatggatgcatcaacccagactggcacacgaaagtctagcacagagtttcgagggcagggtcacgatcgacccgagacacgtacatcaatacagacctactagaactacgacncctaaccctaaaatcgacgaacgaccgacgacccgttacgtacttactggtagccggaaggacggacgtaacggacgttaccctacgtttacggtaattaaggtcggtcggttttaacgcgttggttaccgttttgacgttttccgggg

SEQ ID NO: 338870 - DNA, 593 bp, Homo sapiens
  misc_feature: GZ8MTXP02G8J3E.38.27.C05.1.454.CMB.2.raw
  modified_base (369)..(369): a, c, t, g, unknown or other
  misc_feature (369)..(369): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagcctggggcctcagtgattgtcccctgccaggtcttccggatatatcttcgacttctactatttacactgggtgtcgccaggtccctggacgaagggcctgaggtggagtgggatgcatcaaccccagactcggacaccacgaaacgtctgacanaacgtagtttcgagggacgagggtacacgatacgaccgagacgacgtcaatacaactacacgtacctacgtacggactacgacgtacctaccctaaaagtctacgaaccgacgaccggtccgttatattacgtagtcgacgtagaggcacgtagtacccgtagttacgttacgtaaagttcggtacggtttacgtaggtagtttacgtttagtacttttcgggg

SEQ ID NO: 338871 - DNA, 564 bp, Homo sapiens
  misc_feature: GZ8MTXP02FL4MM.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatgggatgcatccaaccccagaactggcgaccacaaagtctgcacagagttcgagggcagggtcacatcgacccgagacacgtcatcaatacacgcctacgtacgaactcacgcctaccctaaaatctacgaacgaccacggccgtactacttactgtgacgagaggcaagacgttacctacgttaggtacttaaaggtcggttacggttttacgagttcgttcgttttagtacgttttaccgggg

SEQ ID NO: 338872 - DNA, 536 bp, Homo sapiens
  misc_feature: GZ8MTXP02H6M9P.38.27.C05.1.454.CMB.2.raw
  modified_base (431)..(431): a, c, t, g, unknown or other
  misc_feature (431)..(431): n is a, c, g, or t
  modified_base (491)..(491): a, c, t, g, unknown or other
  misc_feature (491)..(491): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccatcccaggtgaaattggtccagtctgggtttggcgtgaggaagcctggggcctcagtgattgtccctgccaggcttccggatatatcttcgacttctactatttacactgggtgcgccaggtcccctggacaagggcctgagtggatgggatgcagtcaaaccccagaaacctggcgaaccacaaaagtctagcacagaagtttcaagggcagggtcacatcgaacccgagactacgcatccaatacagctacctgaacncagctacctaaaatcacgacacacggaccgacctattaacgtcgagcgagacggcaaagngtccacttggtataagtcgtcgtttacgatgtctttgaactttgg

SEQ ID NO: 338873 - DNA, 639 bp, Homo sapiens
  misc_feature: GZ8MTXP02IWB5S.38.27.C05.1.454.CMB.2.raw
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactataggagcagctacttagcctggtaccagcaaaactggaccaggctcccaggcctcctcatttatggtgcgtccaccgaggccactggcatcccagacagattcagtcggcagtgcgtcgtgggcagacttcactctcgtgntcganagactcggacccaagagtatttgctgtgtatttactgttacaactactagttcgggtcctttaccgggcgttacggtaccggtttaccgggaccgtaaacgggggtaaccccgtaaaagggggttacggtaaaacggttccggaaaacgtttaccgggtaaaaccgttggggttaaaccggggtccgtttacggaacccgtaaacccggttaacttcccgttaggttttccctttaccggtaaccttttcccccgg

SEQ ID NO: 338874 - DNA, 565 bp, Homo sapiens
  misc_feature: GZ8MTXP02HSUX3.38.27.C05.1.454.CMB.2.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctnagtgattgtccctgccaggcttccggatatatcttcgacttctactatttacactggtgcgcaggtcccgnggacaaggctgagnggagtggangcatcaaaccagtaacnggacacagtaaagtcagacacaagtagtacgaggacgacgacacacacgaaccgacgacgacgacacacaataacacgacgtaccgtacgaacacgacgactaacctaaactactacgacgaacgaccgtaccgtactacttacgtacgtagacgacggacgacgacgtacgtacgtacgtacgtaagtaagtaagtcgttacgtacgtagtcgtttcgttacgttcg

SEQ ID NO: 338875 - DNA, 544 bp, Homo sapiens
  misc_feature: GZ8MTXP02H01SA.38.27.C05.1.454.CMB.2.raw
  modified_base (226)..(226): a, c, t, g, unknown or other
  misc_feature (226)..(226): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaaggagcccactcccaggtgaaattggtccagtctgggtttgcgtgaggagcctggggcctnagtgattgtcccctgccaggcttccggatatatcttcgacttctactatttacactgggtgcgcaggtccctggacaagggcctgagtggatgggatgcatcaaccccaagaactggacgaccacaaaagtctagcaacagagtttcagggcagggtcacatgacccgagacacgtcatacaaatacagacctaactgaactcaagcctaccctaaaatcctagaaccacaacgggcctactattaactgtcgcgagacggcaagagtacccacgttggtaataaagtgcggttttcgatgtacttttgtactttcgg

SEQ ID NO: 338876 - DNA, 551 bp, Homo sapiens
  misc_feature: GZ8MTXP02F2ILO.38.27.C05.1.454.CMB.2.raw
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggctttggcgtgaggaagccgtggggcctcagtgattcgtcccctgccaggcttccggatatatcttcgacttctactatttacactgggtncgcaggtccctggacagggcctgagtggatgggatgcatccaaccccngaactggccgacacaaagtctgcacngaagttcagggcagggtcaccatcgacccgagacacgtcccatacaactacacgccctaaccgtggaacctcacgtacctaccctaaaatccgtagaaccgacgaccggctactattacgtgtcgcgagaggtacagtacgttaccacgttggtaataagtgtacggtttgattcgtctttgttacg

SEQ ID NO: 338877 - DNA, 583 bp, Homo sapiens
  misc_feature: GZ8MTXP02H478D.38.27.C05.1.454.CMB.2.raw
  modified_base (285)..(285): a, c, t, g, unknown or other
  misc_feature (285)..(285): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctgggcctcagtgattgtccctgccaggcttccggatatatcttcgacttctactatttacacgtggtncgccaggtccctggacaggcctgagtggatgggatggcacgtcaaacccccagaaccgtggacgaccaacaaagtctagcaacgagtagtttcagggcagggtcaacatacgacccgagacaccgtaccactacaaactacacgtaccctaccgacggaacctacaccgtaaccttaaccccttaaaatcctaacggaccgaacgaccggtacctacttaactaccgtgtacgcgacgnganactacgtactacgtgtataagtcgtacggtttacagtgtctttagtactttacggg

SEQ ID NO: 338878 - DNA, 703 bp, Homo sapiens
  misc_feature: GZ8MTXP02GTUSD.38.27.C05.1.454.CMB.2.raw
  modified_base (224)..(224): a, c, t, g, unknown or other
  misc_feature (224)..(224): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctgggttgcgtgagagccgtgggcctnagtgattcgtcccctgccaggcttccggatatatctcgtacttctacttatttacacgtgggtcgcgccgacggtccccaggacaacggggcctggagtggatgggatgacataccaaaccccagaactcggcgaaccacaaagtctagacaagaagtaggtttcgaggggtacgacggggtaccaacgtaacgtaccggaaacccgaagaacccgtaaccgtacccgtaaataacccgtaaaactaccgaaccgtaccccttaaaccgttacggaaacttaccgaactaacccttaacccttaaaactccgtaacgaaccgtaaccgaccggtacccgttattaaccgtttacgtcggtacggacgtaacgggacgtacgacggtaacgtttacctaaacggtttaggtaaacgttacggttcggtttacggttttacggaagtttcggttacgtttttaggtaacgtttttccgggg

SEQ ID NO: 338879 - DNA, 655 bp, Homo sapiens
  misc_feature: GZ8MTXP02JZNSA.38.27.C05.1.454.CMB.2.raw
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactggtgcgccaggtccctggacaaggcctgagtggatgggatggcactccaaccccagaacctggacgaccacgaaagtcagcaacagagttcgagggcaggtcacatcgacccgagacacgtccatacaatacacgaccctaaccgtcggaacctacgacgtacctaaccctaaaagtcctacgaaccgtaccgaccggtacccgttactaacttaaccgtgttacggacggaacggaacgggtacgaaacggtaaccggtttacccgtaaccgtttaggggtaaaccgtttaaaaggggttcggtttacccggggtttttacgtaacggtttacggtttccgttttttaggttacgtttttaacccggggg

SEQ ID NO: 338880 - DNA, 540 bp, Homo sapiens
  misc_feature: GZ8MTXP02FQYLR.38.27.C05.1.454.CMB.2.raw
  modified_base (355)..(355): a, c, t, g, unknown or other
  misc_feature (355)..(355): n is a, c, g, or t
  modified_base (479)..(479): a, c, t, g, unknown or other
  misc_feature (479)..(479): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactattacactgggtgcgccaggtccctggacaagggcctgagtggatgggatgcatcaaccccagaactggcacacaaagtcngcacagagttcagggcagggtcacatgacccgagacacgtccatacaatacagccctactacgaactcacgcctaccctaaaatctagaccgacacggccgtctacttactgtgcgagacgganacgtactccgacgttcgtaataagtggtcggttttacgacttgtctttgtacttttacggg

SEQ ID NO: 338881 - DNA, 607 bp, Homo sapiens
  misc_feature: GZ8MTXP02HO45W.38.27.C05.1.454.CMB.2.raw
  modified_base (286)..(286): a, c, t, g, unknown or other
  misc_feature (286)..(286): n is a, c, g, or t
  modified_base (395)..(395): a, c, t, g, unknown or other
  misc_feature (395)..(395): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtccccttcaggcttccggatatatcttcgacttctactattacactgggtncgccaggtccctggacaagggcctgagtggagtggatggcataccaaccccagaaacctggacgacaccgaaagtctgacacgagtaagttcgagggcagggtccacancgacccgagacacgtacatacaatacacgtacctaactcgaactcgacgtccttaaccctaaaatccgtacgaaccggaacgtaccggaccgttacttaacgttacgtagtacggacgagtacggacgaaggtacgttacccaacgttcggtaagttaacggtcggttaacggtttacgacgttagttcctttggtacgtttacggtcgggg

SEQ ID NO: 338882 - DNA, 618 bp, Homo sapiens
  misc_feature: GZ8MTXP02GTK8P.38.27.C05.1.454.CMB.2.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattgtcccctgccaggcttccggatatatcttcgacttctactattacacgtgggtncgccacggtccctggacgaacgggcctggaggtggagtggggatgacactaccaaaccccagaaactcggacaaccaacaaagtctagacaacgagtagtttcgaaggggcacgggtacaccgagtacgacccgagacacgtaccatacaaatacacgaccctaacgtagaacctacacgacctaaccctaaaatcgtaacgaaccgaaccaccggtaccgtacttaacttaaccgtgtagaccggaaggacggacgacgtacgttacctacgttaggtaagttaaggttgttcggttttacgagttcgttacttttagtacgttttcgg

SEQ ID NO: 338883 - DNA, 681 bp, Homo sapiens
  misc_feature: GZ8MTXP02IUCWB.38.27.C05.1.454.CMB.2.raw
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctnagtgattgtcccctgccaggcttccggatatatcttcgacttctactattacactgggtncgccaggtccctggacaaggcctgagtggatgggatgcatccaaaccccagaacgtggacgaaccacaaagtctagacacagtacgtttcgaaggggccgacggggtaccaaccgagtacgacccgagaccacgtaccactacaaagtaccacgtccctaaccgtacggaaccttaccacgtaccctaacccgttaaaatcccgttacgaacccgaaccgaccggggtacccttacgttaacgttaccgtacggttacgacggtaacggtacggaccgtaaacggttaccgttaccgtaccgtttaagggttaacgttaaacgggttcggtttaccggggtttttaccgtaaaggtttcgtttaccgtttttaggttaacgtttttcccggggg

SEQ ID NO: 338884 - DNA, 540 bp, Homo sapiens
  misc_feature: GZ8MTXP02GGAQA.38.27.C05.1.454.CMB.2.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatggggatgcatcaaaccccagaactggcaccacaaagtctgcacagagtttcagggcagggtcacatcgaccgagacacgtcatcaatacagcctactagactacagcctaccctaaatctacgacgaccacggccgtctattacgtgtgcgagagcagtacgttaccacgttaggtacttaagtgttccggtttacgattgtcttttgtacttttacggg

SEQ ID NO: 338885 - DNA, 603 bp, Homo sapiens
  misc_feature: GZ8MTXP02G7E25.38.27.C05.1.454.CMB.2.raw
  modified_base (227)..(227): a, c, t, g, unknown or other
  misc_feature (227)..(227): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattcgtcccctgccaggcttccggatatatcttcgacttctactattacactgggtgcgccaggtcctggacagggcctgagtggagtggatgcatccaaccccagacgtggacaccacaagtcagcacagtagttcgagggcagggtcacatcggacccgagaccacgtccatcaaataccacgtccctaacgtacggaactcgacgtccctaacccgtaaaatcctacgaaccgaccgacggccgttacttaacgttctcgtcgacgtaggacgcgacggttacgttaccgtacgtttacggtaagtttaacggttcggttacggtttttagacgtttcggttacgtttttacggtacgtttttccgggg

SEQ ID NO: 338886 - DNA, 576 bp, Homo sapiens
  misc_feature: GZ8MTXP02IJTHI.38.27.C05.1.454.CMB.2.raw
  modified_base (288)..(288): a, c, t, g, unknown or other
  misc_feature (288)..(288): n is a, c, g, or t
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagtgattcgtccctgccaggcttccggatatatcttcgacttctactattacactgggtncgccaggtccctggacaagggcctgagtggagtgggatgcatcaaccccagaactggacaccacaaagtctagacacagtagtttcgagggcagggtcacatcgacccgagacacgtcanacaatacacgccctaacctacgaactacacgtccctaacctaaaactctacgaaccgacgaccggaccgttactacttactacgtcgacgacgacggacacgtacgttctacgttacggtaataaggtcggttacggtttacgtattcgttcgtttgtacgtttcggg

SEQ ID NO: 338887 - DNA, 569 bp, Homo sapiens
  misc_feature: GZ8MTXP02JA4RS.38.27.C05.1.454.CMB.2.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattgtcccctgccaggcttccggatatatcttcgacttctactatttacactgggtncgcaggtcctggacagggctgagtggatgggatgcatccaacccagactggcaacacaaagtctagacacgagtagttcgaggggcaggggtcaacgtanacgaacccgagacacgtaccatacaatacacncctaccgtacgaactacacgacctaaccctaaaatctacgacacgaccggctactactactgacgagaggacgtacgaacggtactcctacgttacgtaagtaagtcggttcggttttacgagttcgttcgtttagacgttttacgggg

SEQ ID NO: 338888 - DNA, 544 bp, Homo sapiens
  misc_feature: GZ8MTXP02HLQN9.38.27.C05.1.454.CMB.2.raw
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
  modified_base (440)..(440): a, c, t, g, unknown or other
  misc_feature (440)..(440): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaatggtccagtctgggtttggcgtgaggagcctggggcctcagtgattgtcccctgccaggcttccggatatatcttcgacttctactatttacacgtgggtgcgccaggtcccctggacaagggcctgagtggangggatgcatcaacccagaactggacaccacaagtcngcacgagagttcgagggcagggtcacgatcgaccgagacacgtcatacatacagcctaccacgactacacgacctaccgtaaanctagacacgaccgcgtactatactgtgcgagacggcagacgttaccacgttacggtaataagtcgtcggtttacgtagttacgttcgtttagtacgtttaccgg

SEQ ID NO: 338889 - DNA, 548 bp, Homo sapiens
  misc_feature: GZ8MTXP02H7NSR.38.27.C05.1.454.CMB.2.raw
  modified_base (290)..(290): a, c, t, g, unknown or other
  misc_feature (290)..(290): n is a, c, g, or t
  modified_base (407)..(407): a, c, t, g, unknown or other
  misc_feature (407)..(407): n is a, c, g, or t
  modified_base (470)..(470): a, c, t, g, unknown or other
  misc_feature (470)..(470): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacacgtgggtncgccaggtccctggacaagggcctgagtggatgggatgcatcaaccccagaactggacaccacaaagtctgacacagagtttcgaggcgagggtcacatcgacccgagacacgtcancaactacacgcctaccgtagaactcagcctacctaaaatctagacgacgacgcgtctattacngtgcgagagcacgtacgtcctacgtgttaactaggttaaggttcggtttacgagttcgtcgttttgtaacgtttcggg

SEQ ID NO: 338890 - DNA, 622 bp, Homo sapiens
  misc_feature: GZ8MTXP02F2A6W.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcgagtgattcgtcccctgccaggcttcggatatatcttcgacttctactattacactgggtncgccaggtccctggacgaaggcctgaggtggatgggatgcatccgaaaccccagaacgtggaccaacacaaagtctgacaacagtagttcaggggtacagggtcacgagtcgaccgagtaccacgtaccatacaactaccacgacctacgtacgaactaccagtcctaacccctaaatcctacgaacgaaccgaccgggaccttcttaacgttaacgtcggttagccgtaaggacggtacaacggtaaccgttcctaaccggtttacggtaacgttaaggttcggttaccgggttttacgacggttagtttccgtttagtcggtttttaaccgggg

SEQ ID NO: 338891 - DNA, 645 bp, Homo sapiens
  misc_feature: GZ8MTXP02HEZCI.38.27.C05.1.454.CMB.2.raw
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagacgcccacccctctcctgccgagggccagtcagactagttaggancagctactgccgtgacagacaaaacngacagcnccngcnctnattngtnctcacgnggcagngcntccagacagnttcagtgcgagtgcgtgtagggactagtaccttacgacttacgtcgtacgacgtacgaacgacgaaccgtaccggaaccccaagttaacgttacgtttacgtccggtttagttacgtttaacgtttaacgttaccggttaaacctaaaccgttacgttaacggtttccggggttaacccgttcccggggtacgttaccgggttacccgggttaccggaaaccgggtaaacggggtaaccgtaagggtaacggtaaacgtacgtaacgttacggtaaacgtggtacgctaacgcgaactcgtcgtctcttcacttccccg

SEQ ID NO: 338892 - DNA, 718 bp, Homo sapiens
  misc_feature: GZ8MTXP02GNKG5.38.27.C05.1.454.CMB.2.raw
  modified_base (291)..(291): a, c, t, g, unknown or other
  misc_feature (291)..(291): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggcctcgagttattcgtcccctgccaggtccttccggatatatcttcgacttctactattacacgtgggtncgcacggtccctggacagggcctgagtggagtgggatgacactccaaccccgagaacgtcggaccgaacaacgaaacgtcgtagcaacgaggttaagtttccggaggggcctacggggtaccaaccgtacgtaccgacccggaacgaacgtacccgtaccaactaacaaactacccaccggtacccttaaccggtagaaaccttacgaaaccgtaccttaaaccctaaaacttccgaaccgaaccggtaacgtaccccggtacgttacctaacgtttaaccgtggtaaccgacggaacggaaccggtacgtaaaggttaccggttaccgtaacggtttacgggtaaagttaaacgggttcggtttaacggttttacggaaaggtttccgtttgttttacgttaacggttttccgggttaaacggggg

SEQ ID NO: 338893 - DNA, 580 bp, Homo sapiens
  misc_feature: GZ8MTXP02FKD4X.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagcctggggcctcagtgattgtcccctgccaggcttccggatatatcttcgacttctactatttacactgggtgcgccaggtccctggacaaggcctgagtggatgggatgcatcaaccccagaactggacgaccacaaagtctagcacagtagttcaggggcagggtcacgatcgacccgagaccacgtaccatacaataccacgaccctacctacggaactcacgcctaccctaaaatctagaccgtacaccggtaccgtactacttactggtgaccggtaggacggcaacggtacgttccctacgttacggtagttaaaggtcggttacggttttacgattggttctttaggtattttccgggg

SEQ ID NO: 338894 - DNA, 635 bp, Homo sapiens
  misc_feature: GZ8MTXP02FW0YT.38.27.C05.1.454.CMB.2.raw
  modified_base (290)..(290): a, c, t, g, unknown or other
  misc_feature (290)..(290): n is a, c, g, or t
  modified_base (439)..(439): a, c, t, g, unknown or other
  misc_feature (439)..(439): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtcccctgccaggtcttccggatatatcttcgacttctacttattacacgtgggtncgccaggtcccctggacagggcctgagtggatgggatgcatccaaaccccagaactggcgaacccacaaaagtctagcaacagtacgttcaggggcaggggtccaaccgatcggaacccgagacccacgtacccatacaaatacgaacncccttaacgagaccttacacgaccttaacccctaaaattccagaaccgaccgaccgggtccctacttaacgttccgtagtcggacggaaggacgggtacaacggtaccgtttaccgaccgtttaggggtaacttaaaggttcggttaccggtttttaacggttacgttcggtttacgtttaggttacggtttcggg

SEQ ID NO: 338895 - DNA, 607 bp, Homo sapiens
  misc_feature: GZ8MTXP02JNOUD.38.27.C05.1.454.CMB.2.raw
  modified_base (222)..(222): a, c, t, g, unknown or other
  misc_feature (222)..(222): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctgggctnagtgattgcccctgccaggcttccggatatatcttcgacttctactattacactggtgcgccaggtccctggacaggcctgagtggatgggatgcatcaacccagactggcaccacaagtctgcacagagtttcagggcaggtcacgatcgacccgagactacgcagtcaaatacacgaccctacgtagaaactacaacgaccgttaccctaaactacacggtaaccgaaccgaccgggtccctacttacgttactacgtgaccgaagggacggacgaacggtacgttacccgtacgtttagggttaaacttaaacgggttcggttaccgggttttaccgtagtttacggtttaccgtttttacggtaaacgtttttaccggggg

SEQ ID NO: 338896 - DNA, 591 bp, Homo sapiens
  misc_feature: GZ8MTXP02J14HV.38.27.C05.1.454.CMB.2.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggattggacctggaggatcgtcttcttggtggcagcagtcaaaggagcccactcccaggtgaaattggtccagtctgggttgcgtgaggagcctggggcctnagtgattgtcccctgccaggcttccggatatatcttcgacttctactattacactgggtncgccaggtccctggacagggcctgagtggatggggatgcatcaaccccagaactggacaccacaaagtcngcacagagttcgagggtcaggggtccacatcgacccgagaccacgtccatcaatacacgcctaaccgtagaacctcgacgcctaacctaaaattcgacgaaccgtaccaccgggtccctacttacttacgtgtacgacggacggaggcacggtacgttcccgagtttacggtaagttaaggttcggttacgggttttacgacgtttggttccgtttttaggtacgtttttccggggg

SEQ ID NO: 338897 - DNA, 627 bp, Homo sapiens
  misc_feature: GZ8MTXP02JNFBK.38.27.C05.1.454.CMB.2.raw
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (351)..(351): a, c, t, g, unknown or other
  misc_feature (351)..(351): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggttgcgtgaggagcctgggcctnagtgattgtccctgccaggcttccggatatatcttcgacttctactattacactgggtncgccaggtccnggacagggcctgagtggagtgggatgcatccaacccagaactggacaccacaagtcngacacagtagttcgagggcagggtcacgatcggacccgagaccgacgtaccataccgaaataccgacgtaccctaaccgtacggtaacctacaaccggtaccttaaacccctaaaatccgtacggaacccgtacgaccgggtaccctacttaacgttacgtggtacgacggaggacggaccaaggtaccgttacccgtagtttacggtaacgttaaaggttcggtttaccgggtttacgtagttcgtttacgttttacggtaacgttttccggggg

SEQ ID NO: 338898 - DNA, 612 bp, Homo sapiens
  misc_feature: GZ8MTXP02G9FY3.38.27.C05.1.454.CMB.2.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgtcccctgccaggcttccggatatatcttcgacttctactattacnctgggtncgccaggtccctggacagggcctgagtggatgggatgcactcaaccccagaactggacaccacaaagtcngcaacagtagttcgagggcagggtcacntacgacccgagtaccacgtccanacaaataccgacgtaccctacgtaccggaactacgactaccttaccctaaaagtcctacgaaccgaccgacggaccgttactaacttacgttcgtacggacgaacggacgggacctaaggtaccgttacccgtacggttacggtaagttacggttcggttacggttttaccgtagtttcggttactttttggaacgttttccgggg

SEQ ID NO: 338899 - DNA, 637 bp, Homo sapiens
  misc_feature: GZ8MTXP02G41UF.38.27.C05.1.454.CMB.2.raw
  modified_base (560)..(560): a, c, t, g, unknown or other
  misc_feature (560)..(560): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtggaggaagccgtggggcctcgagtgattcgtcccctgccaggtcctccggatatatcttcgtacttctactactttacacgtgggtcgcgccgtacggtcccgtaggacgaagggcctaggaggtggagtgggatgcactaccaaccccgagaacctggacgaccaacaaagtctcgacaacgagtacgtttcggacggtcgagggtccaacgacgacggacccgagaccacgaccatacaactaccgactaccctacgtacgtacgacaccgtactaaccctaaagtcccacgtacccgaccgaccggtaccttacgttacttacgtacgtcgacggtacgaccggtanacgtacgttacgttacgttaggtaacgtaaggtcggttacggtttagtacgtttcgttacgtttggtacgtttcggg

SEQ ID NO: 338900 - DNA, 779 bp, Homo sapiens
  misc_feature: GZ8MTXP02GQH7T.38.27.C05.1.454.CMB.2.raw
  modified_base (290)..(290): a, c, t, g, unknown or other
  misc_feature (290)..(290): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctgagtgattcgtcccctgccaggcttccggatatatcttcgacttctacttattacactgggtncgccaggtccctggacaaggcctgagtggatgggatgcataccaacccagaactggacgaccaacaaaacgtctagaccaacgtaagtaacggttttcgaagggggtccgaacgggggttaccaacccgaagtaccgaaacccccggaagaacccaaccggtacccaactaaccctaaaacttaccgaacgtaccccgtaaacccgttacgggaaacccttaccgaacggttaaccccttaaacccccgttaaaaacttcccgttaaccggaaacccggtaaacccgaacccggggtaccccggtttaccttaaaccgtttaccgttacgggttacggacccggtaaagggaaccgggtacgtaaacggtaaccggtttacccgtaaaccggtttacgggttaaagtttaaacgggttaacggtttaccggggtttttaaccggaaagtttcggtttaccgtttttaggttacgtttttaacccggggg

SEQ ID NO: 338901 - DNA, 568 bp, Homo sapiens
  misc_feature: GZ8MTXP02GM4CD.38.27.C05.1.454.CMB.2.raw
  modified_base (226)..(226): a, c, t, g, unknown or other
  misc_feature (226)..(226): n is a, c, g, or t
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (420)..(420): a, c, t, g, unknown or other
  misc_feature (420)..(420): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggtcttccggatatatcttcgacttctactatttacactgggtncgccaggtcccctggacaagggctgagtggatgggatgcatccaacccagaactggcaccacaagtcngcacagtagttcgagggcaggggtcacatcgacccgagacacgtccatcaatacacgacctacngaactcagacctacctaaatctagacgacaccggctcgtaacttactgtcgacgacgaggcacgacgttaccgacgttacggtaattaaagggttcgttaccgggttttacgtacgttggttacgtttttacggtacgttttaccggg

SEQ ID NO: 338902 - DNA, 556 bp, Homo sapiens
  misc_feature: GZ8MTXP02INNZ1.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaaggcctgagtggatgggatgcatcaaccccagaactggcgaccacaaagtctgcacagagttcaggggtcagggtcacatcgacccgagacacgtcatcaaatacagccctactacggaactcagcctaccctaaaatcctagaccgacaaccggccgtactaacttactgtgcgagacggacagtacgttaccacgtttaggtaattaagtggtcggttttcgtacttggttcttttgtacgttttcgg

SEQ ID NO: 338903 - DNA, 615 bp, Homo sapiens
  misc_feature: GZ8MTXP02GVW92.38.27.C05.1.454.CMB.2.raw
  modified_base (225)..(225): a, c, t, g, unknown or other
  misc_feature (225)..(225): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctnagtgattgtcccctgccaggcttccggatatatcttcgacttctactatttacactgggtgtcgccaggtcccctggacaagggctgagtggatgggatgcatcaccccagaactggacaccacaaagtctgcacagagttcaggggcagggtcacagtcgacccgagaccacgtacagtacaaactacaagtaccctaccgtacggaaccttacacgtacctaccctaaaaactctacgaaccgaccgaccgggccttacctaacttaactcgtacgacggtacggacggacaacgtaacggttccctaacgttacgggtaattaaaacggtggttacccgggttttacgtaagttacgttaccgtttttggttaacgtttttccgggg

SEQ ID NO: 338904 - DNA, 570 bp, Homo sapiens
  misc_feature: GZ8MTXP02JJVC0.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagccgtggggcctgagtgattcgtcccctgccaggtcttccggatatatcttcgacttctactatttacactgggtgcgccaggtccctggacaagggcctgagtggatggggatgcagtccaaccccagaactggcaccacaaagtctgcacagagtttcagggcaggggtcacgatcgacccgagacacgtcatacaatacacgcctactacggactacacgacctaccctaaaatcctacgaaccgacaccgggtcctacgtattaccgtgtagagacgagacacgtagttaccacgttaggtaacttaaggtcggtacggtttacgtagttcgtcgttttagtacttttcggg

SEQ ID NO: 338905 - DNA, 660 bp, Homo sapiens
  misc_feature: GZ8MTXP02HC4M6.38.27.C05.1.454.CMB.2.raw
  modified_base (222)..(222): a, c, t, g, unknown or other
  misc_feature (222)..(222): n is a, c, g, or t
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
  modified_base (597)..(597): a, c, t, g, unknown or other
  misc_feature (597)..(597): n is a, c, g, or t
  modified_base (643)..(643): a, c, t, g, unknown or other
  misc_feature (643)..(643): n is a, c, g, or t
tcagtcgatcacgtcacgaccggtgctcgatttagacgcgatcgaagggtttggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagctgggcctnagtgattgtcccctgccaggcttccggatatatcttcgacttctactatttacactgggtncgccaggtccctggacaagggcctgagtggatgggatgntactaccaacccgagtaacgtcgggacaacccaaacgaaacgtcgtacgacaacgaacgttagttcgggaacgggtcgtacggggtaccaacgagacccgggaaacccgagtaaaccccgtaccgtaccaactaaccaaaacttaccgaccgtaacccttaacccggtacgaaaccttacggaccgtaacccttaaaccccgttaaaatccgtacgggaaacctaccggaccggttaaccctctttaaacgttcgtaggtcggaccgtaggacgngtacgtacgtcttacgttagtataaggtcgttacgtttgacgtttnttacgtttgtacgtcgg

SEQ ID NO: 338906 - DNA, 553 bp, Homo sapiens
  misc_feature: GZ8MTXP02IHA12.38.27.C05.1.454.CMB.2.raw
  modified_base (315)..(315): a, c, t, g, unknown or other
  misc_feature (315)..(315): n is a, c, g, or t
  modified_base (415)..(415): a, c, t, g, unknown or other
  misc_feature (415)..(415): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctgggcctcagtgattcgtcccctgccaggcttccggatatatctcgacttctactatttacactgggtgcgccaggtccctggacaagggcctgagtggntgggatgcatccaacccagaacgtggacgaccaacgaaaacgtctcgacacagtagtttcgagggcgacgggtcaacatcgaccagacacgacatacaanacacgcctactacgactcacgacctaccctaaatcctagacaccacgcgtactacttactgcgtacgaggagacacgtacgttacctacgttacggtaataggtcgtcggtttcgattgttacttttgtagtttcggg

SEQ ID NO: 338907 - DNA, 784 bp, Homo sapiens
  misc_feature: GZ8MTXP02H75RI.38.27.C05.1.454.CMB.2.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggactggaggatcgtcttcttggtggcagcagtcaaaggagcccactcccaggtgaaattggtccagtcgtgggtttgcgtgaggaagcctggggcctcagtgattgtccctgccaggcttccggatatatcttcgacttctactattacactgggtncgcctaggtccctaggacaacgggcctgaggtggagtgggatgcgatccgaaacccctagaaaccgtgggacaacccaacgtaaaacggtcctacggacaaccgaaggtaacgtttacggaacgggaccgtaacgggggtaccaacccggaaattacccggaaacccccgaacgtaaacccgtaaccgttacccaaactaccgtaaacttaaccgaaccggtacccctaaccgttacggaaacctaccgaacgtaaccccttaacccttaaaaatcccgtaacggaaccgaaccgtaaccccggggtacccgttaaccttaacgtttaacccgtggtttacggaacccgggtaaggaacgggtacccgtaagggttacccgtttaaccggtaccgttttaaacggggttaacgtttaaaaaggggtttccggtttaccggtttttaacgggtgtttaaccggtttttccgttttaggttttacgttttaacccggggg

SEQ ID NO: 338908 - DNA, 593 bp, Homo sapiens
  misc_feature: GZ8MTXP02GE20D.38.27.C05.1.454.CMB.2.raw
  modified_base (289)..(289): a, c, t, g, unknown or other
  misc_feature (289)..(289): n is a, c, g, or t
  modified_base (547)..(547): a, c, t, g, unknown or other
  misc_feature (547)..(547): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggcttccggatatatcttcgacttctactattacacgtgggtncgccacggtcctggacaaggcctgagtggatgggatgcataccaaaccccagaaactgggacactaacaaagtcagcaacagagttcaggggacaggggtcaacatcgaacccgagacacgcatacaaatacagcctacgtacgaactcacacctaacctaaagtccagaaccgacgtaccggacctacgttaactccgtagtacggacgaaggacggaccgaaggtacgttaccctacgttacggtaagttaaaggngtttccggtttacggtattcgtttcgtttagttacgttttcggggg

SEQ ID NO: 338909 - DNA, 619 bp, Homo sapiens
  misc_feature: GZ8MTXP02GADZ2.38.27.C05.1.454.CMB.2.raw
  modified_base (355)..(355): a, c, t, g, unknown or other
  misc_feature (355)..(355): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtggaggagcctggggcctcagtgattcgtcccctgccaggtcttccggatatatcttcgtacttctacttatttacacgtgggtcgcgccacggtccctggacgaagggcctgagtggagtggatggcatccgaaacccagaacgnggcaaccaacaaacgtcagacaacgagtagtttcgaggggcgacggggtccaactagtccgaacccgacgaccacgtaccataccaaacacacgaccctacgtacgaacacgtacgacctaaccctaaaatccctacggtaaccgaccgaccggtacctacgttacttacgtgtacgacgaggtacggcgagtacgtactacgttaggtaattacggtaaggttccggtttagtacgttcgttacgttttagtacgtttacggg

SEQ ID NO: 338910 - DNA, 576 bp, Homo sapiens
  misc_feature: GZ8MTXP02HRF9H.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgcaggtcccctggacaagggcctgagtggatgggatgcatcaacccagaactggcgaccacaaagtctgcacagagtttcgaggcagggtcacgatcgacccgagaccacgtccatacaatacacgccctacctaggaactacacgtacctacccttaaaatctacgaccgacgaccggccgttactattactgtgacggtacgacggcacgtcgttacctacgttcgtaacgttaagttcggttacggttttacgacgttcgttacgttttggtacgttttccggg

SEQ ID NO: 338911 - DNA, 540 bp, Homo sapiens
  misc_feature: GZ8MTXP02IRCLU.38.27.C05.1.454.CMB.2.raw
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggattatatcttcgacttctactatttacactgggtgcgccaggtcccctggacaagggcctgagtggatgggatgcntcaaccccngaactggcacacaaagtctgcacagagtttcgagggcgagggtccaacagtcgacccgagaccacgtccatacaataccagtccctacaggactacagcctacctaaatctagacgacncgctctatntgtgcgngagnagtactcctacgttaggtactaagtcggtacggttttcgattgtacgtttcgacgttttcggg

SEQ ID NO: 338912 - DNA, 532 bp, Homo sapiens
  misc_feature: GZ8MTXP02JBQ3G.38.27.C05.1.454.CMB.2.raw
  modified_base (226)..(226): a, c, t, g, unknown or other
  misc_feature (226)..(226): n is a, c, g, or t
  modified_base (337)..(337): a, c, t, g, unknown or other
  misc_feature (337)..(337): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctnagtgattgtcccctgccaggcttccggatatatcttcgacttctactatttacactgggtgcgccaggtcccctggacaaggcctgagtggatgggatggcagtcaacccngaactggcaccacaaagtctagcacagagttcagggcagggtcacatcgacccgagacacgtcatcaatcagcctacngactacganactacccaaatctacgacacgacgcgtctattacngtnacgtagacggcaggattcccattacggtataagtcgtcggtttacagttcgtcttttcggtatttccggg

SEQ ID NO: 338913 - DNA, 657 bp, Homo sapiens
  misc_feature: GZ8MTXP02HIV7U.38.27.C05.1.454.CMB.2.raw
  modified_base (380)..(380): a, c, t, g, unknown or other
  misc_feature (380)..(380): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcgagtgattcgtcccctgccacggtcttccggatatattcttcgtacttctactatttacacgtggtgcgcacggtcctggacagggctggagtggagtgggatcgacactaccaaaccccgagacgtggaccgtaaccaactaaagtcacganaaccaagtacgtttcggagggtacgacgggaccaacagtaccggacccgagaacctacgtacaagtacaaacgtaccaacgtaccctaacgaccgaacgtaccgtaccgtacctaacccttaaacgtctaaccggaccgaaccgaccgtaccgtatttaacgtcgtagtcggtaccgaggacggacgaacgtacgttaaaccgtacgttaaggttacgtaacgggttaacgttcgggtttactaggttacgttccgtttagttacggttttccgggg

SEQ ID NO: 338914 - DNA, 597 bp, Homo sapiens
  misc_feature: GZ8MTXP02GZNXN.38.27.C05.1.454.CMB.2.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtncgccaggtcccnggacaggcctgagtggatgggatgcactacaaccccagactggacaccacaaagtctagcacaagtacgtttcaaggggtcacggggtaccaccgagtccggaacccgagaaccgacgtaccaagtaccaaataccacgtaccctaaccgtacgaacctacgacgacctaaccctaaaatccgtacgaaccgaaccgaccggaccgttacttacgttacgtgtacgacggtaacgacggacgagtacgttcctacgtacgtataagtgtacgtttcgagttgtactttgtagtttcgg

SEQ ID NO: 338915 - DNA, 651 bp, Homo sapiens
  misc_feature: GZ8MTXP02GCYG4.38.27.C05.1.454.CMB.2.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagccgtggggcctcagtgattgtcccctgccaggcttccggatatatcttcgacttctactattacactgggtncgccagtccnggacaaggcctgagtggagtgggatgcatccaaaccccagaactggacgaaccaacaaagtctagacaacaaggtacgtttcgaaggggtcgaacgggggttccaaccgacgtaccggaacccgaacgaaccgtaccgtaccataccaaaactaccgacgtaccctaacccgtacggaaccttacgaaccgtaccttaaaccccttaaaacgtccgtaacgtacccgaaccgaccggtaccgttacttaacttacgtgtacgacgaggacggcaagtacgttacgtacgttacggttaagttaacggtcggtttacggtttacgtacgttgtttcgtttagttacgtttacggg

SEQ ID NO: 338916 - DNA, 608 bp, Homo sapiens
  misc_feature: GZ8MTXP02I8O7U.38.27.C05.1.454.CMB.2.raw
  modified_base (286)..(286): a, c, t, g, unknown or other
  misc_feature (286)..(286): n is a, c, g, or t
  modified_base (398)..(398): a, c, t, g, unknown or other
  misc_feature (398)..(398): n is a, c, g, or t
  modified_base (494)..(494): a, c, t, g, unknown or other
  misc_feature (494)..(494): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctgagtgattcgtcccctgccaggcttccggatatatcttcgacttctatattacagtgggtncgccaggtccctaggacaagggcctgagtggatgggatgcatccaaccccagactggacaccacaaagtctagcacgagagttcaggggcagggtcaacgatcgaacccganaccacgtaccaatcaaatcaacgctaacctagaacctacgacgtcctaacccttaaatcgtacgaaccgtaccgacgggtccttactaacttacgngtacgacggaacgtacggcgaacggtacgttaccgtacgttacggttattaaacgggttcggttacggtttttacgaggttcgtttacgtttttacggtaacgtttttccgggg

SEQ ID NO: 338917 - DNA, 697 bp, Homo sapiens
  misc_feature: GZ8MTXP02GGO3Z.38.27.C05.1.454.CMB.2.raw
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtcccctgccaggtcttccggatatatcttcgacttctactattacactgggtncgccnggtccctggacaagggcctggagtggatgggatgcgactccaaaccccagaactggacgaaccaacaaaagtctaggacaacgtaagtaaggtttcgaaggggtaccgtaacggggtccaaaccgagtacgaacccggaagaaccctaccggtacccaataccaaacttaaccgacgtacccctaaccgtacgggaaaccttaccgacgtaccttaaccccttaaaacgtcctacggaacccgaaccgaccgggtacccgtacttaacttacgtacgtacggaccgaaggacggacgtaacggtaacgttacccgttaacggttacggtaaagtttaaacggtcggtttacggggttttaccgtaaggttcgtttaccgttttaggttacgtttttaccggggg

SEQ ID NO: 338918 - DNA, 634 bp, Homo sapiens
  misc_feature: GZ8MTXP02FXH12.38.27.C05.1.454.CMB.2.raw
  modified_base (204)..(204): a, c, t, g, unknown or other
  misc_feature (204)..(204): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagcccaccctctcctgcagggccagtcagactattaggagcagctacttagcctggtaccagacaaaacctgcaggctccaggctcctcatttatggtgcgtcccaccgagggccacgtggcactcccgagaccagtattcgagtggcagtgcgtcgtgggaccagacttcacctctcgtagactcgactacgacgtacggaacccaagtacgtattttcgcgttagtacgttacttacgtacgttacaacgtacgttacgttcgggttaccttcccgggtacgttcgtaccggttacggaccggaaaacggggtacccgtaaagggtaccggtaaaaggtaccgtaaacggttaccggtaaagttcggtacgaccgttacggaaccctaccgtacttaccgttcgttaccctttacgactttccccg

SEQ ID NO: 338919 - DNA, 566 bp, Homo sapiens
  misc_feature: GZ8MTXP02HQ7XL.38.27.C05.1.454.CMB.2.raw
  modified_base (290)..(290): a, c, t, g, unknown or other
  misc_feature (290)..(290): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctgagtgattcgtcccctgccaggcttccggatatatcttcgacttctactatttacactgggtncgcaggtccctggacaagggcctgagtggatggatgcatcaaccccagaacgtggacaccacaaagtctagcacagtacgtttcagggcagggtacacgatcgacccgagacacgtaccatacaatacactacctaccgtaggaactcaactacctaaccttaaaatctagaccgtacaccggccgtactacttactagtacgacgagacggacagtacgtacctacgttacgtagtaagtggtacgtttacgactgttcgtttagtagtttacgg

SEQ ID NO: 338920 - DNA, 597 bp, Homo sapiens
  misc_feature: GZ8MTXP02HRMJS.38.27.C05.1.454.CMB.2.raw
  modified_base (290)..(290): a, c, t, g, unknown or other
  misc_feature (290)..(290): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcgagtgattcgtcccctgccaggcttccggatatatcttcgacttctactatttacactgggtncgccaggtccctggacaagggcctggagtggatgggatgcatcaacccagaactggcgacacaaagtctgcacagagtttcaggcaggggtcaccgatcgacccgagaccacgtaccataccaaatacacgaccctacctagaactcacgacctacctaaaatctacgaccgacgaccggtaccgtactacttactcgtacgacggacggaggcaaacggtcgtttaccccgacgtttaggtaaacgttaaggtcggttacggttttaccggtacttagtttccgttttagtacgtttttaccgggg

SEQ ID NO: 338921 - DNA, 617 bp, Homo sapiens
  misc_feature: GZ8MTXP02IGNV8.38.27.C05.1.454.CMB.2.raw
  modified_base (226)..(226): a, c, t, g, unknown or other
  misc_feature (226)..(226): n is a, c, g, or t
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggaggccactcccaggtgaaattggtccagtctgggtttggcgtgaggagcctggggcctnagtgattcgtccctgccaggcttccggatatatcttcgacttctactattacacgtgggtncgccgacggtccctggaacaagggcctggacgtggatgggatgacactaccaaaccccgagaaccgtggacgaaccaacgtaaagtcctagacaaacgaagtacgtttcgaacgggaccgacggggtaccaccgaagtaccggaacccgagaaccacgtaccatacaaactacacacctacgacgaactacacgtactacctaaatctacgaccgacgaccgtacctactacttactgtacgcgacgacgacacgtacgttaccgtacgttacgtaacgttagtcggttacggtttacgtacgttcgttcgtttacgttacgtttacggg

SEQ ID NO: 338922 - DNA, 755 bp, Homo sapiens
  misc_feature: GZ8MTXP02I3CTF.38.27.C05.1.454.CMB.2.raw
  modified_base (226)..(226): a, c, t, g, unknown or other
  misc_feature (226)..(226): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtggggcctnagtgattcgtcccctgccaggccttccggatatatcttcgtacttctacttatttacacgtgggtgccgccaggtccccgtaggaccaacgggcctggaggtggagtgggatgctactacccgaaaccccagtaaaccgtcgggaccgaaccaaccgaaaacgtctacggacaacgtaaagtacggtttacggaaagggggccgtaacgggggttcccaaccggacgtaccgggaacccccgaaggtaccccgtaaaccgttacccaacttacctaaaacgttacccaacggtacccccttaaaccgtaccgggaaacccttaccgaaccgttaaccctaaaccccttaaaattcccgtacggaaacccgtaacccggaccggttaccgttacctttaaacggttcttacgggcgaccggaaaggtcgggaaaccgtacggttacgttacccttacggttaagtaacgtttagttaacgggttcggttttagtacggttgtttaccgttttaaggtcgtttttaccggg

SEQ ID NO: 338923 - DNA, 527 bp, Homo sapiens
  misc_feature: GZ8MTXP02F89FZ.38.27.C05.1.454.CMB.2.raw
  modified_base (358)..(358): a, c, t, g, unknown or other
  misc_feature (358)..(358): n is a, c, g, or t
  modified_base (462)..(462): a, c, t, g, unknown or other
  misc_feature (462)..(462): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaaccccagaactggcaccacaaagtctncacagagtttcagggcagggtcacatgacccgagacacgcatacaatacagacctaccgtagaactcagcctaccctaaatctagacacacggcgtctactacngtcgcgagagcacgtacgtacctacgttgtataagtgtcggtttacgatgttctttgtatttcgg

SEQ ID NO: 338924 - DNA, 586 bp, Homo sapiens
  misc_feature: GZ8MTXP02I5Q5J.38.27.C05.1.454.CMB.2.raw
  modified_base (288)..(288): a, c, t, g, unknown or other
  misc_feature (288)..(288): n is a, c, g, or t
  modified_base (396)..(396): a, c, t, g, unknown or other
  misc_feature (396)..(396): n is a, c, g, or t
  modified_base (427)..(427): a, c, t, g, unknown or other
  misc_feature (427)..(427): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagccgtggggcctcagtgattcgtcccctgccaggcttccggatatactcttcgacttctactattacacgtgggtnccgccaggtccctggacaggcctgagtggatgggatgcataccaaccccagaactgggacaaccacaaagtctagcacagtacgttcgaagggcaggggtaccacgancgacccgagtaccacgtccaataccaaacgnaacctacgacgtaccttacgaacgtcccaaacgacttccaaaccgataccgacgtaccgtactaacgtccgttcgtacgtactaggtacgcgaggttacggacctaggtacgtacgtaacgtcgttaacgtagtagcgtttgtagttcttaggtttcgg

SEQ ID NO: 338925 - DNA, 539 bp, Homo sapiens
  misc_feature: GZ8MTXP02JO78S.38.27.C05.1.454.CMB.2.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctgggcctnagtgattgcccctgccaggcttccggatatatcttcgacttctactatttacacgtgggtncgccaggtccctgacaaggctgagtggatgggatgcagtccaaacccagaactggcgacctacaaagtctgcacagtacgttcagggcagggtcaacgatcgacccgagaacccacgtcccaatcaaatacaacgccctactagaactcgactcctacctaaatcagacacgacgcgtctactatgtgcgagagcgacgtcgtactacgtaggtataagtgtcggtttacgtatcgttctttagtactttacggg

SEQ ID NO: 338926 - DNA, 582 bp, Homo sapiens
  misc_feature: GZ8MTXP02I84KU.38.27.C05.1.454.CMB.2.raw
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtcccctggacaggcctgagtggatgggatgcatcaccccagaactggcacacaagctgcacgagagttcgagggcagggtcacatcgaccganaccacgtcatcaatacgacnctacctagaactcagcctaaccctaaatccgtacgaaccgtacgaccggtacctactatacgttgacgcgaacggtacggatacggtacggttcctaacggtttaggtaaccgttaaaggtcggtacggtttttacggaacttcggttacctttttaggtaacgttttccgggg

SEQ ID NO: 338927 - DNA, 710 bp, Homo sapiens
  misc_feature: GZ8MTXP02IHPJU.38.27.C05.1.454.CMB.2.raw
  modified_base (229)..(229): a, c, t, g, unknown or other
  misc_feature (229)..(229): n is a, c, g, or t
  modified_base (293)..(293): a, c, t, g, unknown or other
  misc_feature (293)..(293): n is a, c, g, or t
  modified_base (420)..(420): a, c, t, g, unknown or other
  misc_feature (420)..(420): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtacaaaggagcccactcccaggtgaaattggtccagtcgtgggtttggcgtgaggagccgtgggcctnagtgattcgtcccctgccaggcttccggatatacttctcgacttctactatttacacgtgggtncgccgacggtcctaggacaagggcctggagtggagtgggatgacactaccaaaccccgagaacgtcggacgaaccaacgaaagtcagacaacgaagtagtttcgaaggacgtacgggtaccaacganaccggaaacccgaacgaaccgtaacccgttaccaaactacctaaacgtacctaacggacccctaaccggtacgtaaacgaccacggtaacccttaaaccttaaaatccgtaacgaaccgtaaccgacccgggtaccttacttaacgttacgtacggtacgaaccggtaaggacggtacgtaaacggttaaccgttaccgtaaccggtttacggttaaagttaaacgggttccggtttacggttttaacggtaagttccggtttacttttaggtttaacgtttaccggggg

SEQ ID NO: 338928 - DNA, 593 bp, Homo sapiens
  misc_feature: GZ8MTXP02IVBBW.38.27.C05.1.454.CMB.2.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (286)..(286): a, c, t, g, unknown or other
  misc_feature (286)..(286): n is a, c, g, or t
  modified_base (359)..(359): a, c, t, g, unknown or other
  misc_feature (359)..(359): n is a, c, g, or t
  modified_base (476)..(476): a, c, t, g, unknown or other
  misc_feature (476)..(476): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagctggggcctnagtnattgtccctgccaggcttccggatatatcttcgactttctactattacacgtgggtntcgccaggtccctggacaagggcctggagtggatggggatgacatccaaaccccagaactcggacaacccaanaaacgtctagacacgaagtacgttcaaggggaccagggtaccaacgatacggaacccgagaccaccgtacaagtaccaaatacacgacctacgacgaactcaacgtactacctaaanctacgaacgacacgccgtatacttctagtnacgtacgngacgngtaacgttccaggttacgtaagtaacggttaaggttcggtttacgtagtcgtttacgttttgaacttttcgggg

SEQ ID NO: 338929 - DNA, 671 bp, Homo sapiens
  misc_feature: GZ8MTXP02JEDXO.38.27.C05.1.454.CMB.2.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggtcttccggatatatcttcgacttctactatttacatgggtncgcctaggtccctggacaaggcctgagtggatgggatgcactccaaaccccagaactggacaaccacaaaacgtctagcaacgaagtacgtttcgaaggggtcgacggggtaccaaccgtagtaccggacccgaagaacccgacgtacctaattacaaaactaccgacgtacccgtaaccgtaggaaactcgaacgtacctaaccctaaaagttcgaacggaaccgaacgacccggtaccgttaccgttaacgtttaacgtcggtacgacggtaacggtacggaccgtaaacggttaccgttacccgtaacgtttacgggtaattacggttaacggttcggttttaacgacgttagttaccgtttttaagtcgttttaccgggg

SEQ ID NO: 338930 - DNA, 588 bp, Homo sapiens
  misc_feature: GZ8MTXP02GOY6G.38.27.C05.1.454.CMB.2.raw
  modified_base (288)..(288): a, c, t, g, unknown or other
  misc_feature (288)..(288): n is a, c, g, or t
  modified_base (362)..(362): a, c, t, g, unknown or other
  misc_feature (362)..(362): n is a, c, g, or t
  modified_base (451)..(451): a, c, t, g, unknown or other
  misc_feature (451)..(451): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggccttccggatatatcttcgacttctactattacactgggtncgccaggtccctggacaagggcctgagtggatgggatgcactaccaaccccagaactggcgaaccacaaagtcngcacgagagtttcgagggcagggtcacgatcgacccgagaccacgtcatacaatacacgccctacgacgactcacgacctaacctaaanctagaccgaccgacggccttactacttacgtgtcgacgaggacgacgacggtacttaccgtacgttaggttaacgttaaggttcggtttacggtttacgttacgttcggtttacttttaggttacgttttaccgggg

SEQ ID NO: 338931 - DNA, 588 bp, Homo sapiens
  misc_feature: GZ8MTXP02IV3B0.38.27.C05.1.454.CMB.2.raw
  modified_base (450)..(450): a, c, t, g, unknown or other
  misc_feature (450)..(450): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtcccctgccaggtcttccggatatatcttcgacttctactatttacactgggtgcgccaggtcccctggacaagggcctgagtggagtgggatggcatccaacccccgagactggcgaaccacaaagtctacgcaacagtagtttcaggggtcagggtccaacgatacgaacccgagaccacgaccatacaaatccagccctacgagaactgacncctaaccctaaatctagaccaccgacggcctctattactgtcgcgagacggtacaggtacgttacccgtacgttaggttaacgttaaggttcggttcggttttacgagttcgtttacttttgtaacgtttttccgggg

SEQ ID NO: 338932 - DNA, 598 bp, Homo sapiens
  misc_feature: GZ8MTXP02J0Y1H.38.27.C05.1.454.CMB.2.raw
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctnagtgattgtcccctgccaggcttccggatatatcttcgacttctactattacactgggtncgccaggtccctggacaagggcctgagtggatgggatgcatccaaccccagaactggacaccacaaagtcagcacagtagttcgagggcagggtccacagtcgaccgagtacacgtacatcaatacacgaccctaccgtacggaacctacacgtacctaacctaaactcgtacgaacgtaccgaccgggttacctacgttacttagtcggtagaccggaggtaggaccgtaaggtacgttaccgacgttacggtaagttaacggtcggtttacggttttacgagtttcgttacgttttagtacgttttccggg

SEQ ID NO: 338933 - DNA, 677 bp, Homo sapiens
  misc_feature: GZ8MTXP02G8WNP.38.27.C05.1.454.CMB.2.raw
  modified_base (290)..(290): a, c, t, g, unknown or other
  misc_feature (290)..(290): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagcctggggcctcagtgattgtcccctgccaggcttccggatatatcttcgacttctacttatttacacgtgggtcncgccacggtccctggaccgaagggcctggaggtggagtggggatgcactaccaaaccccgagaacgtcggacgaaccaacaaagtctagcaagagtagtttcgaggggacgaggggtacaaccgtataccggaacccgacgacccgacgtaccactacaaactacacgccctaaccgtaggaacctacacgtaccttaaccctaaaactccgtaacggaacccgaaccgtacccggtaccgttaccttaacgttacgttacggtacggaccgtaaggacggacgtaacggtaccgttaacctacggttaaggttaacgttaaaacggttcggttacgggttttacgtacggtttcggtttactttttacggtacggtttttccgggg

SEQ ID NO: 338934 - DNA, 726 bp, Homo sapiens
  misc_feature: GZ8MTXP02HXF4D.38.27.C05.1.454.CMB.2.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccacctctccngcagggccagtcagactagtaggancagtctactagccgtggtaccagacaaaaccgtggaccaggcctacccgaggcctaccgtactatttagtggtcgtccgtacccaccgagggcccaacgtggacctacctcccgaagaccaagtactttacgaacggttcggactaggtcgtccggttacggtcggggacctaggtaacctttccgaaccgttccgtcgtagtacttccgaacgacgtaccgtaccgggaaccctaaaacgtagttaacgtttttcgaccgttagttacgttaaactttaccgtaggttaaccaaaccgttaacgttaacggttcggggttacccttaccggggtcgttaccggttaccgggttacccggtaaccggtaaacgggtaacccgtaaagggtcggtaaacgttacaaacggttacgtaaaccgtgtacgggtactacggtaacctaccgtacttccgttacgtacctttactacgtttcccccg

SEQ ID NO: 338935 - DNA, 605 bp, Homo sapiens
  misc_feature: GZ8MTXP02G2KUD.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcgagtgattcgtcccctgccaggcttccggatatatcttcgacttctactatttacactgggtcgcgccaggtccctggacaagggcctgagtggatgggatgacataccaaccccagaaccgtcggaccgaccacgaaagtctacgccaacgaagtacggtttcgaggggtaccgacggggttccaaccgtagtaccggaacccgagaccacgtaccaactacaataccacgtaccctacctacggaactacacgtacctaacccgtaaatctacgaccaccgacggtcctactattactgtacgcgacgaggcagtacgtcgtacgttgtaagtaggttggttacgtttcgagttcgtcgttttagtacgtttcggg

SEQ ID NO: 338936 - DNA, 724 bp, Homo sapiens
  misc_feature: GZ8MTXP02IGHZN.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggagccgtgggcctcagtgattcgtcccctgccaggcttccggatatatcttcgacttctactattacacgtggtcgccgccgacggtcccgtggacgaacgggtccgtggagtggagtgggatgactactaccaaaccccgaagaaaccgtcggaccgtaaacccgaaaccgtaaaacggtccgtacgaccgaaacgtaaacggtaaccggttttacgaaacgggggtaccgtaaacggggttacccaaccggtaaactacccgggaaacccggtaaacgaaacccgtaacccgtacccaaacgtaccgtaaaacgtacccgaacgtaccccctaaccgtaaccgaaacctaccgaccgtacccttaaacccttaaaacgtccgtaacgaaccgaccgaccggtaccttacgttacttacgtgtacgacgtacggagcgtaacgtacgttactacgttacgtaagtagttcgttcggttacgtacgttgttacgtttagtacgtttacggg

SEQ ID NO: 338937 - DNA, 599 bp, Homo sapiens
  misc_feature: GZ8MTXP02FSDMF.38.27.C05.1.454.CMB.2.raw
  modified_base (517)..(517): a, c, t, g, unknown or other
  misc_feature (517)..(517): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagcctggggcctcgagtgattgtcccctgccaggcttccggatatatcttcgacttctacttattacacgtgggtcgcgccgtacggtccccgtaggacgaagggcctaggagtggagtggggactgcactacccaaaccccgagaacgtgggaccaccgaaccaaacggtctagacaacaaggtacgttacgaggggtcagggtccaacgagtacgacccgagaccacgtcatcaacacacgacctaacgacgaacacacgacctaaccgtaaatcgtagaccacgacggtcctactattacgngtcgcgtagagtccagtacgttacacgttacgtagtaacgtcggttacgtttacgagttcgtttcttacgtcgtttaacggg

SEQ ID NO: 338938 - DNA, 627 bp, Homo sapiens
  misc_feature: GZ8MTXP02J2J8V.38.27.C05.1.454.CMB.2.raw
  modified_base (316)..(316): a, c, t, g, unknown or other
  misc_feature (316)..(316): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggttggcgtgaggaagccgtggggcctcagtgattcgtcccctgccaggtcttccggatatatcttcgacttctactattacacgtgggtgcgcacggtccctggacgaggctagngtgagtggatgcatccaacccagaccgtggaccgaccaacgaaacgtctacgacacgaagtacggttcgaggggtcgagggaccaacgcgtacggacccgacgaccacgtaccactacaactacaccgtacctaacgacgtacctcgtacgtacctaacctaaacgtactacggtaaccgaccgacccggtacctactacgttaacgtgtacgacgacggacggacgacggttacgtcccgtagttacggtaagttaacggttggttacggtttacgtagttacggttaccttttaggtacgtttaccggg

SEQ ID NO: 338939 - DNA, 583 bp, Homo sapiens
  misc_feature: GZ8MTXP02IGCNC.38.27.C05.1.454.CMB.2.raw
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (556)..(556): a, c, t, g, unknown or other
  misc_feature (556)..(556): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggagcgtggggcctnagtgattcgtcccctgccaggcttccggattatacttcttcgtacttctactattacactgggtncgcacggtccctggacaagggcctgngtggagtgggatgcataccaaccccagaactggacaccgaacaaagtctgacacgagtagtttcgagggacgacggggtcaccgatacgacccgagacctacgcatacaatacagaccctactagactacacgtacctaaccttaaatcgtacgacgaccgacggtctactattactgtgacgagaggctacgtacgttactacgttacggttaataacggttcgttcggtttacgtnttaggtttctttagttacgtttcgggg

SEQ ID NO: 338940 - DNA, 569 bp, Homo sapiens
  misc_feature: GZ8MTXP02H5FP1.38.27.C05.1.454.CMB.2.raw
  modified_base (290)..(290): a, c, t, g, unknown or other
  misc_feature (290)..(290): n is a, c, g, or t
  modified_base (409)..(409): a, c, t, g, unknown or other
  misc_feature (409)..(409): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttgcgtgaggaagcctggggcctcgagtgattcgtccctgccaggcttccggatatactcttcgacttctactatttacactgggtncgcctaggtccctggacaagggcctggagtggatggggatgcatccaacccagaacgtggacaccacaaagtctgcacagagttcgaaggcagggtcacgatcacccgagacacgccancaatacacgacctacgtacgaactcacgtacctaaccgtaaaactcgtacgacgacgaccggtccgtactattaccgtgtcgacgagacggtcacgtacgttccacgttacggtataaggtcgtcggtttacgatcgtttcgtttagtttacgtttcggg

SEQ ID NO: 338941 - DNA, 672 bp, Homo sapiens
  misc_feature: GZ8MTXP02IQHJN.38.27.C05.1.454.CMB.2.raw
  modified_base (572)..(572): a, c, t, g, unknown or other
  misc_feature (572)..(572): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattgtcccctgccaggccttccggatatatcttcgacttctactattacacgtgggtgcgcacggtccctggacgaaggcctggagtggagtgggatggacataccaaacccccagaacgtggacaaccaacaaagtctaggaccaaacgaagtaacgtttcgaggggacgtaggggtaccaaccgagtaccggaacccgaacgaacccgacgtacccaattacaaaactacaacggaccctaaccgtaggaactacgacgtacctaacccctaaaatcctaacggaaccgaaacgaccggtaccgttacttaacgttaccgtaggtaccgaggaacggnggtaacgaacggtacgttaaccgtacgttaacggttaagttaaacggttggttaccgggttttacgagttcggtttcgttttaggttacgttttccgggg

SEQ ID NO: 338942 - DNA, 566 bp, Homo sapiens
  misc_feature: GZ8MTXP02IGZQA.38.27.C05.1.454.CMB.2.raw
  modified_base (287)..(287): a, c, t, g, unknown or other
  misc_feature (287)..(287): n is a, c, g, or t
  modified_base (429)..(429): a, c, t, g, unknown or other
  misc_feature (429)..(429): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattcgtcccctgccaggcttccggatatatcttcgacttctactattacactgggtncgccaggtccctggacaagggcctggagtggatgggatgcatcaaccccagaactggcaccaacaagtctagcaacgagtagtttcagggtcagggtcacgatcgaccgagacacgtcatacaatacagcctacgtagactnacgcctaccgtaaatctagaccgacgaccgccgtactaacttctagtagcgaggtacggcacggtacgttccgtacgttaggtaacgttaaagtcggttacggttttcgtagttcttcgtttttgacgttttccggg

SEQ ID NO: 338943 - DNA, 535 bp, Homo sapiens
  misc_feature: GZ8MTXP02FP2L8.38.27.C05.1.454.CMB.2.raw
  modified_base (287)..(287): a, c, t, g, unknown or other
  misc_feature (287)..(287): n is a, c, g, or t
  modified_base (486)..(486): a, c, t, g, unknown or other
  misc_feature (486)..(486): n is a, c, g, or t
  modified_base (518)..(518): a, c, t, g, unknown or other
  misc_feature (518)..(518): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtncgccaggtcccctggacaagggcctgagtggatgggatggcatcaaccccagaactggcacacaaagtctgcacagacgttcagggcagggtcaacagtcgacccgagacacgtacatcaataccagaccctaccagaacctcacgtacctaccctaaaatctacgaacgaccacgcgtactatactgtgacgagacgnacgtacgttcacgttgtataagtgtcggtttnattgtctttgatttcgg

SEQ ID NO: 338944 - DNA, 536 bp, Homo sapiens
  misc_feature: GZ8MTXP02G21GW.38.27.C05.1.454.CMB.2.raw
  modified_base (412)..(412): a, c, t, g, unknown or other
  misc_feature (412)..(412): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactattacacgtgggtgcgccaggtccctggacaagggcctgagtggatgggatgcatccaaccccagaactggacaccacaaagtcagcacagagttcgagggcagggtccacatcgaccgagaccacgtcatacaatacncgacctacgcgaactcagacctacctaaaatctacgacaccgacgcgtactacttactgtcgacgacgnggacacgtactctacgttacgatagtgtcgtttnattcgtctttgtacgtttcgg

SEQ ID NO: 338945 - DNA, 575 bp, Homo sapiens
  misc_feature: GZ8MTXP02G6YK8.38.27.C05.1.454.CMB.2.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgtccctgccaggcttccggatatatcttcgacttctactatttacacgtgggtncgccagtcccnggacgaacggcctggagtggatgggatgcatccaacccagactggcacacaagtctagcacgaataggttcagggtcagggtcacganacgaccgagaccacgaccatacaatacacgtaccctaactaggaacctcacgtacctacctaaatcgtacgacacgaccgctacgtactcgtagtcgacgtaggacgacgtacgtacgtccgtacgttaggtaacgttaagtcggttaacggtttccaggtttcgtttcgtttacgttacgttttccggg

SEQ ID NO: 338946 - DNA, 615 bp, Homo sapiens
  misc_feature: GZ8MTXP02GLCVO.38.27.C05.1.454.CMB.2.raw
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
  modified_base (418)..(418): a, c, t, g, unknown or other
  misc_feature (418)..(418): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctgggtttgcgtgaggagccgtggggcctcagtgattcgtcccctgccaggccttccggatatatcttcgactttctactattacacgtgggtncgccacggtccctggacgaagggcctgagtggatgggatgcatcaacccagacnggacacacaaagtcagacacagtagttcgaggcgtagggtccacagtacgacccgagaccacgtacatcaaanacacgcctacctcgaactcacgacttaaccctaaatccgtacgaccgaaccgacggtccctacttaacgttacctggttacggacggtaaacggacggacgtaacggttaaccgttcccgtaaccgtttacggttaagtttaacggtcggtttacggttttacgattcggtttactttaggttacgttttacggggg

SEQ ID NO: 338947 - DNA, 625 bp, Homo sapiens
  misc_feature: GZ8MTXP02G5MV2.38.27.C05.1.454.CMB.2.raw
  modified_base (293)..(293): a, c, t, g, unknown or other
  misc_feature (293)..(293): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctgggttggcgtgaggagccgtggggcctcgagtgattcgtcccctgccaggcttccggatatattcttcgacttctacttattacacgtgggtcncgcctacggtccctaggacaacgggcctaggagtggagtggggatgcactaccaaccccgagaaccgtggacaccaacaagtctgacacagtacgttcgagggcgaggggtaccacgtagacgacccgagaccctacgtaccattaccaaataccacgaccctacgtacgaactacacgtactactaacgtaaatccgtaagaaccgaccgtaccggtaccttacttacgttacgtcgacggaccggaaggacggaccgtagtaccgttacctaggttacggttaacgtaaggttcggttacggtttacagtttcgtttcgtttacgtacgg

SEQ ID NO: 338948 - DNA, 579 bp, Homo sapiens
  misc_feature: GZ8MTXP02IBJ13.38.27.C05.1.454.CMB.2.raw
  modified_base (283)..(283): a, c, t, g, unknown or other
  misc_feature (283)..(283): n is a, c, g, or t
  modified_base (558)..(558): a, c, t, g, unknown or other
  misc_feature (558)..(558): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctgggcctcagtgattgtccccttcaggcttccggatatatcttcgacttctactattacactgggtncgccaggtcccctggacaagggcctggagtggatggggatggcactccaacccccgagaactggacgacaaccgaaagtcacgcacagaagtttcgagggcgagggtccaccgatcggacccgagaccacgtaccatcaaatacacgacctaccgtagacctcgacgcctacctaaaacgtctacgacgtaacgacgtccgtactacttaccgtgtacgcgacgtacgcgagtacgttactacgttagtacgtagtgtcggtttacgtagtcgtnttttacgtactttcgtacggg

SEQ ID NO: 338949 - DNA, 589 bp, Homo sapiens
  misc_feature: GZ8MTXP02JT4RE.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggaagccgtggggcctcagtgattcgtcccctgccaggcttccggatatatcttcgacttctactatttacactgggtgcgccacggtcctggacaagggcctgagtggagtgggatgcataccaaccccagaacctggacgacccaacgaaacgtctgacacagtagtttcgaggggcagggacaccagtacgacccgagacaccgtacactacaaatacacgtacctacctaggaacctacgacgacctaccctaaatctacgacgaccgacgtaccgtctaacttctagtcgaccgtaggagtacgaacggtacgttacctacgttagtacgttaagtcggttcgtttcgtatggtttctttggtacgtttacggg

SEQ ID NO: 338950 - DNA, 615 bp, Homo sapiens
  misc_feature: GZ8MTXP02J1TBB.38.27.C05.1.454.CMB.2.raw
  modified_base (374)..(374): a, c, t, g, unknown or other
  misc_feature (374)..(374): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtggaggaagccgtggggcctcagtgattcgtcccctgccaggtcttccggatatatcttcgacttctacttattacacgtgggtgcgccgaggtcccctggacgaagggcctggagtggatgggatggcatccaacccagaactcggacaccacaaagtcgtacncaacgaagtacgttcgacggggcagggtaccacgagtcgacccgagaccacgtaccatacaacacacgacctaccgacgaactacgacgtacctacccgtaaatctacggaaccgacaccgggtaccttacttacttacgtagtgaccggtagacgcgaacgggtacttaccgtacgttacggttaattaacgggtcgttaccggtttagacgtttgtttccgtttaggtcgtttccgggg

SEQ ID NO: 338951 - DNA, 531 bp, Homo sapiens
  misc_feature: GZ8MTXP02FTDP7.38.27.C05.1.454.CMB.2.raw
  modified_base (168)..(168): a, c, t, g, unknown or other
  misc_feature (168)..(168): n is a, c, g, or t
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggttgcgtgagagcctggggcctnagtgattgtcccctgccaggcttccggatatatcttcgacttctactatttacactgggtncgccaggtccctggacagggcctgagtggatgggatgcatccaaacccccagaaaccgtggcgaacccacaaagtctagcacagtacgttcgagggtcagggtcacatcgaccngacncgtcatcaaanacagcctacagtaacncacgacctacctaaatcctagacacncggaccgtntatacngtcgnacgngcagacgttccattggtataacgtgtaccgtttgatgtcttacgtatttcgg

SEQ ID NO: 338952 - DNA, 630 bp, Homo sapiens
  misc_feature: GZ8MTXP02HZO83.38.27.C05.1.454.CMB.2.raw
  modified_base (286)..(286): a, c, t, g, unknown or other
  misc_feature (286)..(286): n is a, c, g, or t
  modified_base (420)..(420): a, c, t, g, unknown or other
  misc_feature (420)..(420): n is a, c, g, or t
  modified_base (490)..(490): a, c, t, g, unknown or other
  misc_feature (490)..(490): n is a, c, g, or t
  modified_base (529)..(529): a, c, t, g, unknown or other
  misc_feature (529)..(529): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtccctgcaggcttccggatatatcttcgacttctactatttacactgggtncgccaggtccctggacaagggcctgagtggatgggatcgacactaccaaccccagaccgtcggacgtaccaacgtaacgtcacgacaacgagtagttacgacgggcggtacggtccactacgaccaacccgganaacccgccgtacactaactaaactaccgacgtccctaaccgtagtaaccacgactaccctaaaccttaancgtacgacgacccgcgggtactacttacgtacgtgacgnggtaacgggcgtacgagtaccgttaccctaggtttaacgttacgttaaggttcggttaccggtttacgtagttcggtttccttttggttacgtttcggggg

SEQ ID NO: 338953 - DNA, 552 bp, Homo sapiens
  misc_feature: GZ8MTXP02JNFTH.38.27.C05.1.454.CMB.2.raw
  modified_base (227)..(227): a, c, t, g, unknown or other
  misc_feature (227)..(227): n is a, c, g, or t
  modified_base (365)..(365): a, c, t, g, unknown or other
  misc_feature (365)..(365): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctnagtgattgtcccctgccaggcttccggatatatcttcgacttctactattacactgggtgcgccaggtccctggacaagggcctgagtggatggggatgcatcaaccccagaactggcacacaaaagtctagcacganacgtttcaggggcaggggtcaaccgatacgacccgagaccacgtccatacaaatacagacctaccgtagaaacctcagcctaacctaaaatctacgaacgacacggccgtactacttactgtagcgacgaggcagacgttctacgtagtaactaagtgtcggtttcgactggtctttgacgtttcgg

SEQ ID NO: 338954 - DNA, 650 bp, Homo sapiens
  misc_feature: GZ8MTXP02JNDX4.38.27.C05.1.454.CMB.2.raw
  modified_base (168)..(168): a, c, t, g, unknown or other
  misc_feature (168)..(168): n is a, c, g, or t
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctgggttgcgtgaggagccgtggggcctcgagtgattcgtccctgccaggccttcggatatactcttcgacttctactattacacgtggtncgccaggtcctggacgaaggcctggagtggagtgggatggacactccaaaccccgagaacgtggcgaaccacgaaagtctacgacgaacagtagtttcgaggggcgtaggggtccaacgtagacgacccgtagaaccgacgtccataactaactaacacgtacccttacgacggacctacgacgaccttaacccgtaaatccgtacggaaccgtaccgaccggtaccgttacttaacgtttacgtacggtagacccggtaaggacggtacgtaacgtacgttacccgtaagtttacggtaacgttaggttaacggttacccggttttagaacgttcgtttacgtttagttcggtttaccgggg

SEQ ID NO: 338955 - DNA, 602 bp, Homo sapiens
  misc_feature: GZ8MTXP02HY7IY.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggtcttccggatatattcttcgtacttctactatttacacgtggtgcgccgacggtcctggacgaacgggcctggagtggagtgggatgacagtaccaacccagaacgtggaccacaacaagtctagacaacgtagtaggtttcgagggcgacggtccaacgagtacgacccgaacgacaccgtccaatactaacgtacacgacctaaccgtacgaacctacacgtacctaacccttaaatcctagacccgacgaccggtccttactacttacgtgtcgacgtcggagcacgtacgtcctacgttcggtaactagttcggtcgtttacgtgttagtcttttacgtcgtttacggg

SEQ ID NO: 338956 - DNA, 654 bp, Homo sapiens
  misc_feature: GZ8MTXP02JTPPN.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgtcccctgccaggcttccggatatatcttcgacttctacttatttacacgtgggtgcgccgacggtcccctggacaagggcctgagtggagtgggatgcataccaacccagacgtggacgaccactaaagtctcgacacgagtacgtttacgaggggtactacgggtccaacgataccggacccgagacccgtacgtaccaacgtacaaacgtaccacgtacccttaacccgtacggaaccttaccgaaccgtaccttaacccccttaaaagtcctacgggaaacccgaccgaccggtcccgttaacttactttaaccgttgtacgacccggtaggtacgacgtacgtacgttccgtaaacgttggttaacgtaagttcggttcggtttacgagttacgttcgttttagagttttaccgggg

SEQ ID NO: 338957 - DNA, 586 bp, Homo sapiens
  misc_feature: GZ8MTXP02FTNLQ.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtaaaattggtccagtctgggtttggcgtgaggaagcctggggcctcagtgattgtcccctgccaggcttccggatatatcttcgacttctatattacactgggtgcgccaggtccctggacaagggcctggagtggatgggatgcatccaaccccagaactggcgacaacccaaagtctgcacagaagtttcaggggcaggggtcaccatacgacccgacgacacgtccatacaatacacacctaacctcggaactcacgacctaccctaaaactctagaccgaccgaccggccgtacttacttactgtcgcgaggacgcgagtacgttacctacgtttacggtaacgtaaggtcgtaaccgggttttacgtagttcgtacgttttagtacgtttcgtacggggg

SEQ ID NO: 338958 - DNA, 620 bp, Homo sapiens
  misc_feature: GZ8MTXP02GUQK5.38.27.C05.1.454.CMB.2.raw
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactccccaggtgaaattggtccagtctgggtttggcgtgaggaagccgtggggcctcagtgattgtcccctgccaggcttccggatatatcttcgacttctacttatttacacgtgggtcnccgccacggtccctggacagggcctgagtggatgggatgcactccaacccagtacgnggacgaaccacaaagtcacgacacgacgtaggttcgagggacgtacgggccaacgactacgacccgaagaccgaccgtacaactacgaaactaccgaacgtaccctaacgtacgtaaccacgtaaaccgtacccttaacctaaaattccgacgaaaccgtaccgaccggtaccttataacgttcgtgtacgacgtaggacgtacgacgtacgtacctacgttacgtataacgtcgtcgtttacgattacgtctttagtacgtttaccggg

SEQ ID NO: 338959 - DNA, 526 bp, Homo sapiens
  misc_feature: GZ8MTXP02FRSDH.38.27.C05.1.454.CMB.2.raw
  modified_base (409)..(409): a, c, t, g, unknown or other
  misc_feature (409)..(409): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtcccctggacaagggcctgagtggatgggatgcatcaaccccagaactggcaccacaaagtctgcacagagttcagggcaggggtcaccagtcgacccgagacacgtcatcaanacagccctactaggaactcacgtctaccctaaatctagacgaccacgcgtactatactgtgcgagaggcagacgtcacgtggtataagtgtacggtttcgatgtctttgactttcgg

SEQ ID NO: 338960 - DNA, 664 bp, Homo sapiens
  misc_feature: GZ8MTXP02FI1WO.38.27.C05.1.454.CMB.2.raw
tcagtcgatcacgtcacgaccggtgctcgatttagacgcgatcgaaggggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggaagccgtggggcctcagtgattcgtcccctgccaggtcttcggatatatctcgtacttctacttattacacgtggggtcgccgccgacggtcccgtaggaccgaagggcctggagtgggagtggatgcactaccaaaccccagaacgtcggacgaacccaacgaaagtctagacacgaagtacgttcgaaggggacgtaggggtccaacgacgtaccggaacccgacgaaccgaaccgtaccaataccgaaactaccgaacgtaccctaccgtaggaacctacacgtacctaaccctaaagtcctaagaaccgaccgtacggaccgttactaacttacgtcgtacgacggaaggacggactaacggtcgttaaccgtacgttaggtaacgttaacggtggttacggttttacgacgtttcgtttagtttacggtacgttttaccggggg

SEQ ID NO: 338961 - DNA, 595 bp, Homo sapiens
  misc_feature: GZ8MTXP02HPAP2.38.27.C05.1.454.CMB.2.raw
  modified_base (319)..(319): a, c, t, g, unknown or other
  misc_feature (319)..(319): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggagccgtggggcctcagtgattcgtcccctgccaggcttccggatatatcttcgacttctactattacacgtgggtgcgccaggtccctggacaagggcctggagnggatggggatgcatccaaacccgagaacgtggacaccaacaacgtctgacaacgagtagttcgagggacacgggtaccacgagtaccgaccgagacgaccgacactacaataccactacccgtacacggaacctacgactacctaacccgtaaatcgtacgacaccgaccggtctactactatgtcgtagacggaggtcacggtacgttcctaacgttagtaagtaaggtcggtttcggtttacgtacgttcgtttacgtttgttacgtttcgggg

SEQ ID NO: 338962 - DNA, 612 bp, Homo sapiens
  misc_feature: GZ8MTXP02I2NF2.38.27.C05.1.454.CMB.2.raw
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttcggatatatcttcgactttctactatttacacgtgggtgcgccacggtccgtcggacgaacggccgtgaggtggagtgggatggcataccaaccccagaacgtggcgaaccaacaaagtctacgacaacctagagtttcgaacgggcgacggggtaccaaccgacgtacggaacccgagaccgaccgtaccaataccaaagttaccaggtacccctaacgtaggaaaccttcgaacgtcctaaccccttaaagtcctagaaaccgaccaccggtaccgttctaagtttccngtacgcgagagtnaacgtgttactcgtagtactaagttgtcgtttcgacttgttcgtttatacgtttacgg

SEQ ID NO: 338963 - DNA, 645 bp, Homo sapiens
  misc_feature: GZ8MTXP02I0ZIN.38.27.C05.1.454.CMB.2.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcacctgtctttgtctccgagggganagagccaccctctcctgcaggccagtcagactataggancagctatagcctggtaccagacaaaacctggccaggctcccaggctcctcatttanggtgcgtccaccgaggccagtcggcactcccagacagtattcagtggcagtcgcgtcgtggggacncgacttcgaccgtcgtcgtagacttcgacaagacgtacggaaccccaagtagttacttttggacttgttacgttaatttaccgttagtaacctaaacgttacttacggttcgggttccttcccgggcgttacggtacccggttacgggaaccggtaacggggtaacccgtaaaggggtacgggtaaacgttaccaaaacggttaccgaaacggtttacggcggtactccgggttaaccaccgttatacccggttgttccctttaccgtacgttttcccccg

SEQ ID NO: 338964 - DNA, 568 bp, Homo sapiens
  misc_feature: GZ8MTXP02FU9WD.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctggggcctcagtgattgtcccctgccaggcttccggatatatcttcgacttctacttattacactgggtgcgccaggtccctggacaagggcctgagtggatgggatgcatccaaccccagaactcggcaaccacaacgtctagcacagagttcagggcagggcacatcgaccgagacacgtcatcaatacacgtaccctacgtacgaactacgacgcctaacctaaatcctagtaaccgaccgacggccgtacttattacctgtcgagtacggaggacacggtacgttacgtacgttacggtagttaacggtggttcggtttacgtagttcgttcgtttgtactttacgggg

SEQ ID NO: 338965 - DNA, 734 bp, Homo sapiens
  misc_feature: GZ8MTXP02F8ES0.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtacaaaggacgcccactcccgaggtgaaagttggtccagtcgttgggtttggcgtgaggagccgtggggcctcgagtgtattcgtcccctgccgaggtccttccggatatatcttcgtacttctacttattacacgtgggtcgcgtccgacggtcccctaggaccgaacgggccgtggagtggagtgggatgacactacccaaacccagaacgtcggacaccaactaaagtctaggacaacgaagtacgttcgagggacgacggggtaccaacgacgtaccgaacccgtaagaacccgaacgtaccaataccaaagtaccaacgtccctaaaccgacggtaacttaccgaaccgtacctaaacccgttaaaatccgtaacggaaccgtaacccgacccggtcgttaaccgttaacttccggtacgtacggacggaacggtacgggtaaacctaacgggttaacgtttaaccccgttacgggttttaaggtaacgtttaaacggggtcggtttacccggtttttaggttacgtttacggttttacgtttttaggtttaaccggttttaccggggg

SEQ ID NO: 338966 - DNA, 593 bp, Homo sapiens
  misc_feature: GZ8MTXP02JYREI.38.27.C05.1.454.CMB.2.raw
  modified_base (572)..(572): a, c, t, g, unknown or other
  misc_feature (572)..(572): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggacgcccactcccaggtgaaattggtccagtctgggtttgcgtgaggagccgtggggcctgagtgattgtcccctgccaggcttccggatatatcttcgacttctactattacactgggtgcgccaggtccctggacaacgggcctgagtggagtgggatggcagtcaaccccagaactggacgaccaacaaagtcgtagctaacgagtaacgtttcgaaggggtccaaggggtccaacctagtacgacccgaagaccacgtccaatacaatacacgtccctaacctaggaaccttcacgtaccctacctaaaatcctacgacgaccgaccggccgttactagttacctgtacgcgacggagtccaggacgttaccacgttgtaacgtagtcgtacggttttacgnttcgtctttgtattttccggg

SEQ ID NO: 338967 - DNA, 572 bp, Homo sapiens
  misc_feature: GZ8MTXP02JDPYV.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggagcctggggcctcagtgattgcccctgccaggcttccggatatatcttcgacttctactatttacactgggtgcgccaggtccctggacaagggcctgagtggatgggatgcatcaaccccagaacctggtgacacaaagtctgcacagagttcagggcagggtcacatcgacccgagacacgtcatcaatacacgcctacgtacgaactcacgtcctacccttaaaatcctacgaccgaccgaaccggcctactaacttcctagtcgacgaggacggccagacgttacccgtacttacgggtaattaaacggtcgttacggttttaccgacgttggttccttttagtacgtttttcggg

SEQ ID NO: 338968 - DNA, 639 bp, Homo sapiens
  misc_feature: GZ8MTXP02JS5VW.38.27.C05.1.454.CMB.2.raw
  modified_base (290)..(290): a, c, t, g, unknown or other
  misc_feature (290)..(290): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagtcgatcacgtcacgaccggtgctcgatttagacgcgatcgaagggtttgggggagagcagtcacccagcaaccacatctgtcctctagagaatcccctgagagctccgttcctcaccatggactggacctggaggatcgtcttcgttggtggcagcagtcaaaggcgccactcccaggtgaaattggtccagtctgggtttgcgtgaggagccgtgggcctcagtgattcgtcccctgccgaggcttccggatagtatcttcgacttctactatttacactggtcncgccaggtcctaggacaaggcctggagtggactgggatgctactaccgaaccccgagaaacgtcggacaccaacgtaaagtctagcanagtacgttcgagggtccagggtcaacgngtacgaccgagaccacgtacattacaatcacgccctacgtacgaactagaccgtacttaaccctaaaagtcctacgaaccgaccgtaaacgggtcccttaatactttaacggcgttacggcgtaacggaacggacctaaacggtcgtttacccggtaacgttacggggtaattaaacggttcgttaccgggttttagacgttcgtttaccgttttaggtaacgtttcccgggg

SEQ ID NO: 338969 - DNA, 550 bp, Homo sapiens
  misc_feature: GZ8MTXP02GVULP.38.27.C05.1.454.CMB.2.raw
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctggttggcgtgaggagcctggggcctcagtgattgtcccctgccaggcttccggatatatcttcgacttctactattacactgggtncgccacggtcctggacaagggcctgagtggntgggatggcatcaacccagaactggacactacgaaagctgacacagtagttcagggcagggtccacatagaccgacgacacgaccaactacaanacacacctactacgactacacactaacctaaactactacgacgacgacgacgtactactacgtacgtgacgacgacgacgacgtacgtactacgtacgtagtagtaagtcgttacgtacgtagtacgttacgttacgttcg

SEQ ID NO: 338970 - DNA, 631 bp, Homo sapiens
  misc_feature: GZ8MTXP02GMTBU.38.27.C05.1.454.CMB.2.raw
  modified_base (290)..(290): a, c, t, g, unknown or other
  misc_feature (290)..(290): n is a, c, g, or t
  modified_base (542)..(542): a, c, t, g, unknown or other
  misc_feature (542)..(542): n is a, c, g, or t
  modified_base (561)..(561): a, c, t, g, unknown or other
  misc_feature (561)..(561): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggttggcgtgaggagcctggggcctcagtgattcgtcccctgccaggcttccggatatatcttcgacttctacttattacacgtgggtcncgccgacggtccctaggacgaaggcctggagtggagtggatgcactaccaaccctaagaacgtggaccaacaacgaaagtctacgacaactaagtacgtttcgacggggcgtacggggtccaacgacgtaccggaacccgagaccgtaccgtaccagtaccaaactaccgactacccgtaccgtacgaacctacgacgtaccctaacctaaactcgtaacggaccgaaccgccggtaccttactacgttacncggtacggacgagacgganaacggtcgttacgtacgttaggtaagtagtggttacgtttacgattcgttatttacgttacgtttacggg

SEQ ID NO: 338971 - DNA, 690 bp, Homo sapiens
  misc_feature: GZ8MTXP02F6V1L.38.27.C05.1.454.CMB.2.raw
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagcctggggcctcagtgattcgtcccctgccaggcttccggatatatcttcgacttctactatttacactgggtgcgccaggtccctggcaagggcctgagtggatgggatgcagtccaaaccccagaactggcaccgacaaagtctggacacgagtacgtttcgagggcgagggtccacctagtcgaacccgtagaccgaaccgtaccaataccgaaataaccgacgtaccccgttaaccgtacgggaaacccttcgaaaccgtacccttaacccccgttaaaaacgttcccttaacggaacccgtaaacccgaaccgggttcccggtaacctttaaactttaccgttaggtacgttacccggaaggtacggtcgaaacggttacgttacccgtaacgtttacgggtaacgttaaacggtttcggtttacccgggtttttagacgttcggtttctttttacggtaactttttccgggg

SEQ ID NO: 338972 - DNA, 605 bp, Homo sapiens
  misc_feature: GZ8MTXP02JATS2.38.27.C05.1.454.CMB.2.raw
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatntcttcgacttctactattacactgggtncgccgaggtccctggacaggcctgacggtggagtggagtgcacgtaccaaacccccgagtaaccgtggccgaaccaccaaagtcctagcaaccgaggtagttcgagggcgacgggtccacacgtacgacccgagaccacgtacagtacaactaccacgtaccctacgtagactcaacgccctaaccttaaanctacgaccgacgaccggtacctnttaactacttggacgtacgaaggacgtactacggtaacgttcctacgttaggtacttaaggtcggtacgtttacgagttgttccttttagtacgttttacggg

SEQ ID NO: 338973 - DNA, 584 bp, Homo sapiens
  misc_feature: GZ8MTXP02IC168.38.27.C05.1.454.CMB.2.raw
  modified_base (292)..(292): a, c, t, g, unknown or other
  misc_feature (292)..(292): n is a, c, g, or t
  modified_base (479)..(479): a, c, t, g, unknown or other
  misc_feature (479)..(479): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtaccnccaggtcccctggacaagggcctgagtggatgggatgcagtcaacccagaactggcgacaaccaaagtctagacacgagtaagtttcgaagggcagggtccaccatacgacccgagacacgtccatcaatacagcctactgactcacgctacctaaatccagaccgacacggccgtactacttacgngtacgacgaagacggactaaggacttacccgacgtttacggtaacttaaggttcgtaacggttttcgagttcggttacgttttagtacgtttttcggaccggggg

SEQ ID NO: 338974 - DNA, 779 bp, Homo sapiens
  misc_feature: GZ8MTXP02JSX56.38.27.C05.1.454.CMB.2.raw
  modified_base (632)..(632): a, c, t, g, unknown or other
  misc_feature (632)..(632): n is a, c, g, or t
tcagtcgatcacgtcacgaccggtgctcgatttagacgcgatcgaagggtttgggggagagcatcacccagcaaccacatctgtcctctagagaatccccctgagagctccgttcctcaccatggactggacctggaggatcgtcttcttggtggcagcagtcaaaggagcccactcccaggtagtaaagttggtccagttcgtgggtttggcgtgaggagccgtggggcctcgagtgactttcgtccccgtgccgtaggtccttccggattagttacttccttacgtaccttcttaacttactttactacgtgggtcgccgccgtacgggtcccctaggaccgaacgggcctggaggtggagtcggggatcggacctacgttaccccgaaacccccgtaaggtaaccgtacgggaccgaaaccccgtaaaccgaaaaggttccctacgaaccgtaaaccgtaaaggttaaccgggtttttccgggaacggggtaccggtaccgggtaccgaaccccgtaacggtaccgggaaacccccgaaaggaaccctaaccggtaccctagttaaaccaaacttaaccgacgtacccctaaacgtacgtaaacctcgaaccgtacctaacccgtaaancgtacgaaccgtaccgacggtccctacgtattacgtggtacgcggtacgacggacgtaacgtacgttaccgttacgtacggttaagttaaggtccggttttacggtttagtacgttagttttccggtttagttacggtttaccgggg

SEQ ID NO: 338975 - DNA, 544 bp, Homo sapiens
  misc_feature: GZ8MTXP02JWID4.38.27.C05.1.454.CMB.2.raw
  modified_base (520)..(520): a, c, t, g, unknown or other
  misc_feature (520)..(520): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctgggggcctcagtgattcgtcccctgccaggcttccggatatatcttcgacttctactattacactgggtgcgccaggtccctggacaagggcctgagtggatgggatgcatcaaccccagaactggacaccacaaagtctgcacagagttcagggcagggtcacgatcgaccgagacacgtcatacaatacagacctactggaacctacacgcctacctaaaatctacgacgacacggccgtactacttactcgtgacgagacggcacgtacgtcacgttgtaataggtgtcggtttacgnttacgtcgttttgacttttacggg

SEQ ID NO: 338976 - DNA, 562 bp, Homo sapiens
  misc_feature: GZ8MTXP02G487F.38.27.C05.1.454.CMB.2.raw
  modified_base (290)..(290): a, c, t, g, unknown or other
  misc_feature (290)..(290): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagccgtggggcctcagtgattcgtcccctgccaggtcttccggatatatcttcgacttctactattacactgggtncgccaggtcctaggacaagggcctgagtggagtcgggatggcatccaaccccagaactcggcaaccacaaagtctagacacgaagtacgtttcgaggcgagggtccaccgatcgacccgagacacgtaccatacaataccagaccctaacctagaactcagcctaacctaaagtcagacaccgacgcctctactactgtcgcgagagcaacgtacttaccgacgttacgtattaagtcgtcggttttacgagttgtctttagtacgtttcgg

SEQ ID NO: 338977 - DNA, 600 bp, Homo sapiens
  misc_feature: GZ8MTXP02IUZ44.38.27.C05.1.454.CMB.2.raw
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtccccttcaggtcttccggatatatcttcgacttctactatttacacgtgggtcncgccaggtccctggacaagggcctggagtggatgggatgctataccaacccagaactggacgacactaaacgtctagcagtagtaagttcgagggcagggtccaaccgagtacgacccgagacacgtacaatacaaactacacgtacctaccgtacggaactcacgtaccttaacctaaaactctacgacgaccgacggtccgtactacttacgtgtacgacgagacggacaagtacgtacctacgttaggtaacgtacgttcgttaacggtttcgtacgttcgttactttcgtacgtttacggtacgggg

SEQ ID NO: 338978 - DNA, 553 bp, Homo sapiens
  misc_feature: GZ8MTXP02JTJCZ.38.27.C05.1.454.CMB.2.raw
  modified_base (398)..(398): a, c, t, g, unknown or other
  misc_feature (398)..(398): n is a, c, g, or t
  modified_base (489)..(489): a, c, t, g, unknown or other
  misc_feature (489)..(489): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattgtcccctgccaggcttccggatatatcttcgacttctactatttacactgggtgcgccaggtccctggacaagggcctggagtggatgggatgcatccaaccccagactggcgaaccacaaagtctgacacagtacgtttcgagggcagggtcacatcgacccgngaccgcgtacatcgaaatacacgtaccctaccgtacggaactccagtacctaccctaaaatcgtagaccgacaccggtcgtactattacgngtcgcgtagaggcagtacgtacacgtgtaataacgtgtacgtttcgatgtctttgactttcggg

SEQ ID NO: 338979 - DNA, 688 bp, Homo sapiens
  misc_feature: GZ8MTXP02JEZS0.38.27.C05.1.454.CMB.2.raw
  modified_base (293)..(293): a, c, t, g, unknown or other
  misc_feature (293)..(293): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggaagccgtggggcctcgagtgattcgtcccctgccaggcttccggatatatcttcgacttctacttatttacagtgggtncgccgacggtccctaggacgaacggcctaggaggtcggaagtggggatcggacactaccaaaccccgagaaccgtggaccaaaccaaccgtaaagtctacgacaactaaggtacgtttcgaaaggggcgtaacggggtccaaccgtagaccggaaacccgagtaacccgacgtacccaacgttacaaactaccgaaccgtacccttaccgaacggtacctaacgacctaccttaaaccctaaagtcccacgaaacccgaaccgtaccgggtaccttacttaacgttaacgttcgggacaccggaggaccgtaagacggtacgttacctagtttacggtaaagttaacggtcggtttacgtttaacgagtttgtaacgtttttgtacgtttccggg

SEQ ID NO: 338980 - DNA, 661 bp, Homo sapiens
  misc_feature: GZ8MTXP02FJLEI.38.27.C05.1.454.CMB.2.raw
  modified_base (291)..(291): a, c, t, g, unknown or other
  misc_feature (291)..(291): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggaagccgtggggcctcagtgattcgccctgccaggtcttcggatatatcttcgtacttactacttattacactgggtnccgcacggtccctggacaaggcctggagtggagtggatgcataccaaccccagaacgtggaccgaaccaacgaaagtctagacaacgaacgtagttacgaggggacgcgggacacagtaccgaccgagaccacgtaccatacaagtaccgacacccgtaacgtacgaacctcacgtacctaaccgtaaatccgtacggaaccaacgacccggtaccgttacttaacgttactcggtacgtacgacgggaacgaccgtacgttaccggttaccgttaacgtttacgggttaacgttaaaagggtttcggttacggggtttttacgtacggtttacgtttacggtttttaccggttaagtttttcccggggg

SEQ ID NO: 338981 - DNA, 693 bp, Homo sapiens
  misc_feature: GZ8MTXP02GPOWG.38.27.C05.1.454.CMB.2.raw
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (651)..(651): a, c, t, g, unknown or other
  misc_feature (651)..(651): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggggcccactcccaggtgaaattggtccagtctgggttggcgtgaggagccgtggggcctcgagtgatttcgcccctgccaggtcttccggatatactcttcgacttctactattacactgggtacncgccacggtcccctggaacaacgggcctaggacgnggacgtgggatggacacgtaccgaaccccgtagaaacctcggacgaacgtaacccaaaacgtctagaccgtaacgaagttaaacggtttcggaggggacgtacggggttaccaacccgtagtaccgaaccccggagaacccgtaccggtacaacgttacaaacttacgacgtaccctaacgtacgactcacgaccttaccgtaaaactctacggaactaccgaccgtaccgttacttagtaacgtcgttagaccgaggtacggcgtaaaggttccgtaacccgttgttaggtaaccgttaggggttactcgggtttttaaccgngtttacggtttcggttttaacgtccgtttttacgggtcgggg

SEQ ID NO: 338982 - DNA, 603 bp, Homo sapiens
  misc_feature: GZ8MTXP02GIYHC.38.27.C05.1.454.CMB.2.raw
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (445)..(445): a, c, t, g, unknown or other
  misc_feature (445)..(445): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggaagccgtggggcctnagtgattcgcccctgccaggcttccggatatatctcgacttctactatttacacgtgggtcncgaccaggtcccctaggacgaaggcctggaggtggaagtcggggatgcactaccaaacccagaactggacaaccctaacgaaagtcagcaacgaagtaggttcagggacgacggtaccaaccgagtacgacccgagaccacgtacactacaaanacgaacgacctaccacgaactacgaacaccttaacctaaactacacgaacgaccgacgtaccgtacctagtactagtacggcgtaacgtacggactacggtattacacgttacgtagtaaagtggttaccgttcacgttatcgtttagtctttacggg

SEQ ID NO: 338983 - DNA, 670 bp, Homo sapiens
  misc_feature: GZ8MTXP02FF57L.38.27.C05.1.454.CMB.2.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (596)..(596): a, c, t, g, unknown or other
  misc_feature (596)..(596): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaaggcgcccactcccaggtgaaattggtccagtcgttgggtttggcgtggaggaagccgtggggcctcagtgattcgtcccctgccaggtccttccggatatatcttcgtacttctacttattacacgtgggtcncgccacggtcctggacgaacggcctgaggtggagtgggntgcactaccaaaccccgagaacgtcgggacaacccaacgtaaagtctacgactaaccgaaggttacgttccggaaaggggacgtaccggggtaccaacgtagaccggaaacccgagaacccacgttacccaataccaaacgtaacacgtaccctacgtacggtaacctcgaaccgtacctaaccccttaaaagtcctaacggaaccgaacccgtaccgggtacccttacttacgtacgtggtacgacggtagaccggntaaacgtcgttactacgttagtaacgttaaggtcgtacggttttacgagttcgttactttacgtacgtttcggg

SEQ ID NO: 338984 - DNA, 687 bp, Homo sapiens
  misc_feature: GZ8MTXP02FKUG8.38.27.C05.1.454.CMB.2.raw
  modified_base (168)..(168): a, c, t, g, unknown or other
  misc_feature (168)..(168): n is a, c, g, or t
  modified_base (289)..(289): a, c, t, g, unknown or other
  misc_feature (289)..(289): n is a, c, g, or t
tcagtcgatcacgtcacgaccggtgctcgatttagacgcgatcgaagggtttgggggagagcatcacccagcaaccacatctgtcctctagagaatcccctgagagctccgttcctcaccatggactggacctggaggatcgtcttcttggtggcagcagtcaaaggngcccactcccaggtgaaattggtccagtctggttggcgtgaggagccgtgggcctcagtgattcgtcccctgccaggtcttccggattatatcttcgacttctactattacactggggtcncgccacggtccctggacgaacggcctggagtcggagtcgggatgtcactcaaccccagaacgtggacaccaacaaagctagaccagacgtagttccgagggtacgtagggtaccacgtacgtcgaaacccgagaaaccaccgtaccaatccgaaaatccgaacaccccgttaccgtacggtaaaccaccgtaccggacccttaaaccccctaaaagttaccctaaccgggaaacccgtaacccgaccggtacccttaccgttaacgttaacccttgggtacggtaccggaaggtacggaacgtacggtaccgttaccgaaccggtttacggtaacgttaagggtcggttacggttttacgtacgtttggtttaacgttttcgggtacgttttacgggg

SEQ ID NO: 338985 - DNA, 650 bp, Homo sapiens
  misc_feature: GZ8MTXP02HPDV0.38.27.C05.1.454.CMB.2.raw
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
tcagtcgatcacgtcacgaccggtgctcgatttagacgcgatcgaagggtttggggagagaagagctgctcagttaggacccagagggaaccatggaaaccccagcgcagcttctcttcctcctgctactctggctcccagatacgaccggagaaagtgtgttgacgcagtctccaggcacctgtctttgtctccgagggagagacgccaccctctcctgcgagggcccagtcaagactagtaggancagctactagcctagtaccagacaaaacgtgccaggcacccgaggcncgtacatttgtagtcgtcgtccgaacgacggacctagtcggatacgtaccaagtacagacttcaggtgacngtacgtgtcgngggtacctaagtcttacgaaactttcgacgtaacggtcaacgtaacgaacggtacgaacggtaaaccgaaacttaccgtaggtttctacgtagttacgtattacgttacgttacgaaacctaatacgtacgggttctaccggtacgtcggtacgttacggtaccgtaaaggtaacgtaacggtacgaaggttaaccgtaaaacgtacggtaacgtacggtacgtacgtacgtaaccgtacgtacgtacgttacttacgttacgttacgttaccg

SEQ ID NO: 338986 - DNA, 623 bp, Homo sapiens
  misc_feature: GZ8MTXP02JHVOC.22.52.E08.1.454.CMB.2.raw
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
tcagacatacgcgtcacgaccggtgctcgatttagtcgagctctctcgaggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagctggcggagtcgtgggggaggccgtggtacgagggcccggggggtccctggagactctcctgtgtagcctccggattcaccttagcagacatggcatgagcgtcggggtcccgccgaggcctaccggaagggggaacggggccggtaggtggggtgtcgagtctaagttagtagtaggtggtagaatagtaaactttaccacacagccgtccgtaggaaacgggccncttacactatctctaaganaacaattccccaagtaaccactactgtaactctagacaaatgacgtagctagaagacgaccgaacgacgaacggcctaatttaacgtacgtgaccggtacgaaaaggcttaaacggtaccgggtacgaacgtaaacggggtcgtacgttaccggtacgtttacgtacgaacgtttccg

SEQ ID NO: 338987 - DNA, 567 bp, Homo sapiens
  misc_feature: GZ8MTXP02FLWDZ.22.52.E08.1.454.CMB.2.raw
  modified_base (424)..(424): a, c, t, g, unknown or other
  misc_feature (424)..(424): n is a, c, g, or t
tcagacatacgcgtcacgaccggtgctcgatttagtcgagctctctcccggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtctggggggaggcctggtacaggccgggggggtccctgagactctcctgtgtagcctccggattcactttagcagacatggcatgagctgggtccgccaggctccgaggggaggggccggagtggggtgtcagtcattagtagtagtggtgatagaatttacacacagactcgtgaaggccgcttcacatctctagagacaattcccagacacatgtatcngacaaatgactaggctaggagacgaccgacgacgaaccggaccctaatttacttaactcgaccgtacggaaaggtatacggtaccggggtacgaacgaaacgggtggacttaaaccggtcgtttacctaggaactcgtacccg

SEQ ID NO: 338988 - DNA, 559 bp, Homo sapiens
  misc_feature: GZ8MTXP01BZCAW.38.53.E09.1.454.CMB.2.raw
  modified_base (277)..(277): a, c, t, g, unknown or other
  misc_feature (277)..(277): n is a, c, g, or t
  modified_base (467)..(467): a, c, t, g, unknown or other
  misc_feature (467)..(467): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaattangataatgccatgcacgtgggtccacaagctaccgaaggggacgggcctgggagtgggtctcgaagtgttagtggaactagtggtaccataagcctgtgccggtactcgtggtaggaacggggccgtattcaccatcctaccagaacgacaacgaccaagacgcctccctagtactctgacaaatgaaacngtctagacgtacctggacgacaacggtccttcgttatttcgtgtcgacgaaacggccccggtaatggaactagtagacgtaaggttgtttcg

SEQ ID NO: 338989 - DNA, 638 bp, Homo sapiens
  misc_feature: GZ8MTXP01DGORR.38.53.E09.1.454.CMB.2.raw
  modified_base (458)..(458): a, c, t, g, unknown or other
  misc_feature (458)..(458): n is a, c, g, or t
tcagtcgatcacgtcacgaccggtgctcgatttagagagagtgtgttgggtctgggggagacttggtagagcctggtaggtccctgagactctcctgtgcagcctctggattcaaatttaatgataatgccatgcactgggtccgacaagctccagggaagggcctggagtgggtctcaagtgttagttggaacagtggtaccatagcctatgcgactctgtgaaggcctattcaccatctcagagacaacgccaagagctccctgtatctgacaaatgaaacagtctgagacctgaggacacggccttctatttctgtcgacaaaacggcccgtatggccagtagctaaagaggtttacttgaactccgtggggacccgtaacggggaaccccgggtcaccgtcctcctcacgccctaccaaccgaacgggcccctaagtccggtcccttcccccgnggcccgcccctcggcctccgaacggacgaccacccgtccgacgacggaccaacgcggcccggtccccgtgggggccttcggccccgttagggttaccgaaacggggtacccttaaacccgtttcccgaaccggttggaacttccggtaaccgggtcgggacgggtccggggcgtaacggg

SEQ ID NO: 338990 - DNA, 672 bp, Homo sapiens
  misc_feature: GZ8MTXP01C7YQP.38.53.E09.1.454.CMB.2.raw
  modified_base (275)..(275): a, c, t, g, unknown or other
  misc_feature (275)..(275): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaattangataatgccatgcacgtgggtccacaagcctccgaaggggacggcctgggagtgggtctcgaaggtgttaggttggaacaggtggtaccataacgcctgtgcggactcgtgtacggaagggcccgtattacacctatcctaccaagaacggaaccaacgacccgaaagacgcccttaccccgtagttaacttcccgtagaacctaaaagtacgaaaccgtagttccgttaaggaacgtaacccgtaggaaccgggtaccgtaaccgggttcccctttatttaacttttcccgttagggttccggaaaaccggttaaaaacccgggggttcccccgggttaaagttccgggaacgtaagggtacggttaccgttaaaacgggttgggtttttaacccg

SEQ ID NO: 338991 - DNA, 539 bp, Homo sapiens
  misc_feature: GZ8MTXP01AFWSH.38.53.E09.1.454.CMB.2.raw
  modified_base (264)..(264): a, c, t, g, unknown or other
  misc_feature (264)..(264): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaaggccattcaccatctcagagacaacgccaagagctcccngtatctgcaaatgaacagtctgagacctgagacacggccttctatttctgtgcaaaaggccccgtatcggcagtagctaagaaggttctttgactccgtggggccaggggacccgttcaccgtctcctcacgcctccaccaacgggcccatccgggtcttccccctggccgtcccctgggctcccgaggacgccaacctccgagacgccacagccggccctgggcttcgccttggtcaaggccttcttccaacgtgctcgacttgaacgcgggcg

SEQ ID NO: 338992 - DNA, 539 bp, Homo sapiens
  misc_feature: GZ8MTXP01EYF9L.38.53.E09.1.454.CMB.2.raw
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaaggccattcaccatctccaganacaacgccaagagctcccngtatctgcaaatgaacagtctgagacctgaggacacggccttctatttctgtgacaaaaggccccggtatcggcagtagctaagaagttcttgactcgtggggcaggggacccggtcaccgtctcctcacgcctccacaacgggccctagtccggtccttcccccgtggccgccctcggctccgaggacgcaccctccgagacgcacacgcgccctggggcttgcccttggtcaaggcttcttccaagtgaactcgacttgaacgttcgggcg

SEQ ID NO: 338993 - DNA, 566 bp, Homo sapiens
  misc_feature: GZ8MTXP01DG3N3.38.53.E09.1.454.CMB.2.raw
  modified_base (241)..(241): a, c, t, g, unknown or other
  misc_feature (241)..(241): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaaggccattcaccatcnccagagacaacgccaagagctccctgtatctgacaaatgaacagtctgagacctgaggacacggtccttctatttctgtgacaaaaggcccgtatcggcagtagctaagaaggttcttgactccgtggggccacgggaccggtcaccgtctctcacgcctccaccgaacggcccatccggtccttccccgtgccgccctcggcctccgacggacgccacccgtccgagaacgcacacggccggccctcgggcttcggcccgttgggtaccgaacgggaccttccttcccgaacgtgaacttccggacgttggaacggccgggtcg

SEQ ID NO: 338994 - DNA, 638 bp, Homo sapiens
  misc_feature: GZ8MTXP01E4WM9.38.53.E09.1.454.CMB.2.raw
  modified_base (274)..(274): a, c, t, g, unknown or other
  misc_feature (274)..(274): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagacttggtagagcctggcaggtccctgagactctcctgtgcagcctctggattcaaattangataatgccatgcacgtgggtccaacgaagcgtaccgaagggggaacgggccgtagggagtggggtctacgaaggttgttagttaggaactagtacggtacccataacgccctaagtcgcgggtactcgtggtaggaacgggccctattaccacctagtcctaccaagacgaaccgaaccgaccaagacgtcctcctagtactctagaacctaaagacgaacgtagtctagaacgtaccgaggtaccggaccgtaaccggttcttacttacgtttcgtaacggtacgaaccggttaaaaccgggttccccggttaagacggtaaccgtaaggtacgttacgttaacggttcggttttaacccgg

SEQ ID NO: 338995 - DNA, 653 bp, Homo sapiens
  misc_feature: GZ8MTXP01C6XOD.38.53.E09.1.454.CMB.2.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (575)..(575): a, c, t, g, unknown or other
  misc_feature (575)..(575): n is a, c, g, or t
  modified_base (621)..(621): a, c, t, g, unknown or other
  misc_feature (621)..(621): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtcagtgtgaagtgcagctggtggagtcgtggggganacgttggtagagcctggcaggtccctgacgactctcctgtgcagcctcgtggattacaaattangaataatgaccagtgccacgttgggacccaacaagcctaccggaagggggacggccgtagggaggtcgggtactagaaaggttgtttaaggttaggaaactaggtcggtaaaccctagtaaacggtaccctaagtcggacgggtaccttcgtggtacgggaaacgggcccgtaattaccaacctaacgttccacccgaaaggaacggaaccaaaccggacaaacggagtccccgtaccctagttactcgtagaacaaatacgaaactaggtcaggaactaccgaggacgaacnccggtcttccgtaattcgtaggtacgacgaaaacggcccggttaangggctaagacgttacttaaggttgtttaaccg

SEQ ID NO: 338996 - DNA, 627 bp, Homo sapiens
  misc_feature: GZ8MTXP01DX53R.38.53.E09.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtgggggagacttggtagagcctggcaggtccctgagactctcctgtgcagcctntggattacaaattangataatgccatgcacgtgggtccacaagctaccgaaggggacgggcctgggagtgggtctacgaagtgttagtggaactagtcggtaccagtaacgcctaagcgacggtactcgtggtaggaacggggcccgtattcacctatctaccgaagacgaacaacgaccaagacgcctccctagtactctagacctaaatcgaacagtactagacgtaccgtaggacggacctaaccgggttcctttacttacgttttccgtaggttcggaaaccgttaaaaccgggttcccccgggtaagttcgggaaccgtaaggtacggttacgttaaggttaacgggttttaaccg

SEQ ID NO: 338997 - DNA, 543 bp, Homo sapiens
  misc_feature: GZ8MTXP01DKDNU.38.53.E09.1.454.CMB.2.raw
  modified_base (463)..(463): a, c, t, g, unknown or other
  misc_feature (463)..(463): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaaggccgattcaccatctccagagacaacgccaagagctccctgtatctgcaaatgaacagtctgagacctgaggacacggcctttctatttctgtgacaaaaggccccgtatcggcagtagctaagaaggttctttgactcgtggggccaggggaacccgggtcaccgtctcctcagcctccaccaagggcccatccggtccttccccgtggccgccctggcctcgaggacgcacccncgagagcacacgccgccctgggccttcgccttggtcaaggcttacttccgaagtggaacttcggacttggaacgcgggcg

SEQ ID NO: 338998 - DNA, 547 bp, Homo sapiens
  misc_feature: GZ8MTXP01BH5T2.38.53.E09.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccaggggaagggcctggagtgggtctcaagtgttagttggaacagtggtaccatagcctatgcggatctgtgaagggccattcaccatctccaganacaacgccaagagctcccngtatctgcaaatgaacagtctgagacctgaggacacggcctttctatttctgtgacaaaaggccccggtatcggcagtagctaagaaggttcttgactccgtggggccaggggaacccgggtcaccgtctcctcacgcctccaccgaacgggccccagtccggtccttccccctggccgcccctgggcctccgacggacgccaccctccgagacgcacgagccggccctgggcttgccttggtcaaggcttcttccaacgtgaactcgattgaagcggcg

SEQ ID NO: 338999 - DNA, 620 bp, Homo sapiens
  misc_feature: GZ8MTXP01B2KKQ.38.53.E09.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaatttaaaaggtgtccagtgtgaagtgcagcgtggtggagtcgtgggggagacgttggtagagcctggcaggtccctgagactctcctgtgcagcctntggattacaaattangataatgacctatcgcacgtgggtaccaacaagcctaccggaaggggaacgggcctgggagttgggtctacgtaagttgtttagtaggaactaggtcggtaaccagtaacgccttaagtcgacgggtactcgtaggtaggaacgggtcccgtattaccaacctacgtcctaccaagaacgaaccaacgaccaaagacgcctacccgtgttactcgttagaaccaaaagtcgaaacgtagtccgtaagacgtaccgtggacgaccgaacggtccctttagttattcgtagtcgaacgaaacggcccggtaatcggaactagtagaccgtaagttcggttcg

SEQ ID NO: 339000 - DNA, 559 bp, Homo sapiens
  misc_feature: GZ8MTXP01B7X37.38.53.E09.1.454.CMB.2.raw
  modified_base (459)..(459): a, c, t, g, unknown or other
  misc_feature (459)..(459): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaattaatgataatgccatgcactgggtccacaagcctaccgaggggaagggcctgggagtggggtctcgaagtgttagttggaacagtggtaccagtaacgcctaagtgcggactcgtgtaggaagggccgattcaccatctccagacgacaacgccaagacgctccctgtactcgtgacaaagtgaacngtctagacgacctgacggcaacgggtccttcgttattcgtagtcgacgaaaacgggccccggtaagtcggcgtaagtacgactaaaggttgggttttccg

SEQ ID NO: 339001 - DNA, 585 bp, Homo sapiens
  misc_feature: GZ8MTXP01DFCFH.38.53.E09.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccgaggggaagggcctggagtgggtctcaagtgttagttggaacagtggtaccatagcctatgcggatctgtgaagggccattcaccatcnccagagacaacgcaagagcnccctgtatctgcaaatgaacagtctgagacctgaggacacggcctttcttatttctgtgacaaacggccccggtatggcagtagctaaagagttcttgactcgtggggccacggggaccgggtcaccgtctcctcacgcctaccaccacgggcccacgtcggtccctcccctcggcccgcccgtcgcctccacggcgccacccgtccggacgcgccacgacggcccgggcccctggggcctcggccgtacgggtccgaaacgggttccttaaccgtttcccgaacggtcgaacgttccggaccgtggaacgggtcccggggg

SEQ ID NO: 339002 - DNA, 602 bp, Homo sapiens
  misc_feature: GZ8MTXP01AXI8V.38.53.E09.1.454.CMB.2.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
  modified_base (476)..(476): a, c, t, g, unknown or other
  misc_feature (476)..(476): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtggggganacttggtagagcctggcaggtccctgagactctcctgtgcagcctctggattcaaattangataatgccatgcacgtgggtcccgacaagctaccggagggggaacgggcctgggagtggggtctacgaagttgttagttggaactaggtcggtaaccagtaacgcctaatggcggactcgtagtggaaacgggccgattcaccatctaccagacgacaacgaccaagcgacctccctagtactctgaccaaagtcgaacngtactagacgtaccgtaggacggaccgtaaccggtccctttacgttactttccgtggtacgaaccgaaaacggggttccccggtaagtcgggaaccaggtacgacgttaaggttaacggttttccg

SEQ ID NO: 339003 - DNA, 727 bp, Homo sapiens
  misc_feature: GZ8MTXP01C78E9.38.53.E09.1.454.CMB.2.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtggggganacttggtagagcctggcaggtccctgagactctcctgtgcagcctctggattacaaattangataatgccatgcacgtgggtccacaagcctaccgaggggaacgggcctagggaggtcgggtactacgaaggttgttagttcggaaacctaggttcggtaacccagtaacggcccttaagtcgggtccgggtaacttcgtggtaggaaacgggggtcccctaatttccgaaccctacttacccgtaccgaaaggaacgaaacccgaaaccgaccgaaacggtacgtacccttaccccgttaggttacttacccgttaggaaacctaaagttacgaaaccgtacgttacgttacggaacgtaccgtaggaacgggtacctaaccgggttcccttttactttacgtttcgttaacggtccggaaaaccggttaaacccggggttaccccggttaaggtccgggtaacgtaagggtacgttaaccgtttaagggttaacggttttttccg

SEQ ID NO: 339004 - DNA, 583 bp, Homo sapiens
  misc_feature: GZ8MTXP01CDWAV.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgacaaatgaacagtctgagacctgaggacacggccttctatttctgtgacaaaaggccccgtatcggcagtagctaagagttcttgactcgtgggccagggacccggtcaccgtctcctcacgcctccaccgaacggcccagtccggtccttccccgtggccgccccttcggcctccgacggacgccacccgtccgagacgccacgacggccggcccgtgggcttcggcccgttcgggtaccgaacgggttaccttaccgtttcccgaacggttcgaacgttccggacgttcggaacgggttcgggccgg

SEQ ID NO: 339005 - DNA, 586 bp, Homo sapiens
  misc_feature: GZ8MTXP01DSIMI.38.53.E09.1.454.CMB.2.raw
  modified_base (280)..(280): a, c, t, g, unknown or other
  misc_feature (280)..(280): n is a, c, g, or t
  modified_base (464)..(464): a, c, t, g, unknown or other
  misc_feature (464)..(464): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacttggtagagcctggcaggtccctgagactctcctgtgcagcctctggattacaaattangataatgccatgcacgtgggtacccgaacaagcctaccgaagggggaacgggcctgggagtcgggtctacgaagtgttagttcggaacagtggtaccataagcctaatgccgactcgtgtggaagggcctatcacatcctcagagacaacgccaagcgctcctgtactctgacaaagtgaaacngtctagactacctggacgacaaccggtctttacttactttcgtacggttacgaaccgttaaaaccgggttccccggtaagtcggaacgtaaggttacgttacgttaaaggttcggtttttcc

SEQ ID NO: 339006 - DNA, 607 bp, Homo sapiens
  misc_feature: GZ8MTXP01CEY51.38.53.E09.1.454.CMB.2.raw
  modified_base (178)..(178): a, c, t, g, unknown or other
  misc_feature (178)..(178): n is a, c, g, or t
  modified_base (215)..(215): a, c, t, g, unknown or other
  misc_feature (215)..(215): n is a, c, g, or t
  modified_base (277)..(277): a, c, t, g, unknown or other
  misc_feature (277)..(277): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
tcagtcgatcacgtcacgaccggtgctcgatttagagagagtgtgttgggtttggggggagaggagccccagccctgagattcccaggtttttccattcagtgatcagcactgaacacagaggactcaccatggagttgggactgagctggattttcctttggctattttaaaaggtntccagtgtgaagtgcagctggtggagtcgtggggganacttggtagagcctggcaggtccctgagactctcctgtgcagcctctggattacaaatttangaataatgccatcgcacgtgggtaccacaagcctccgaagggggaacggcctggagtgggtctacgaaggttgttagttaggaacccaggtaggtaaccctagtacggacccttaagtcggaccggtaactcgtaggtaggaaacgggggtcctattccaccatccgtaccaagacgaaccgaaacgaccaaaggacgcctacccgtagtactccgtgaacaaatgaaactagtctagacgacctaggacgacacggtcttnttattcngtacgacaaacgggcccgttaagtgggactaagtacgacgttaagtcggtttcgttaacgg

SEQ ID NO: 339007 - DNA, 624 bp, Homo sapiens
  misc_feature: GZ8MTXP01DMMFU.38.53.E09.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggatttttccttttggcttaattttaaaaggtgtccagtgtgaagtgcagctggtggagtcgtgggggagacttggtagagcctggcaggtccctgagactctcctgtgcagcctntggattacaaattangataatgccatgcacgtgggccaacaagcctaccgaaggggaacgggccgtagggaggtgggtctacgaaggttgttagttacgaactaggtggtaccagtaacgcctaagtgcgactcgtggtagacgggccgtattcacctactctaccgagacgacaaacgaccgaaagacgcctacccgtagttactctgaaccaaagtagaaacagtctagacgtacctaggacggacaaccggttcctttacgttactttcgttacgtcgaaccggaaaaccgggttccccgggtaagtacggaaccgtaaggtacggttaccgtttaaaggttcggttttaacccg

SEQ ID NO: 339008 - DNA, 691 bp, Homo sapiens
  misc_feature: GZ8MTXP01DBLNW.38.53.E09.1.454.CMB.2.raw
  modified_base (285)..(285): a, c, t, g, unknown or other
  misc_feature (285)..(285): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctgggtggagtcgtgggggagacttggtagagcctggcaggtccctgagactctcctgtgcagcctctggattcaaaatttaanagataatcacatgactacgtcggaccaacaacgccgtacggaagggggacggtcgtagggaggtcggtactagtaaggttgttaggtacggaacgtaggtacggtaaccagtaacgtaccttaagtcggacggtactcgtagggtacgggaacgggtccctacttaccaacctactaccgtaccgaagaacgaaaccgaaccgaccgaaagcgtccctacccgtagtacgtacgtacgaactaaagtacgaaacgtagtacgtagaacgtaccgtaggaaccggtaccgtaaccggttccctttacgtttactttcgtacggtaacgttaaaccgggttaaacccgggttcccggttaagtacggtaacgtaaggtacggttacgttaaacggtttcggtttaacg

SEQ ID NO: 339009 - DNA, 576 bp, Homo sapiens
  misc_feature: GZ8MTXP01B72Q6.38.53.E09.1.454.CMB.2.raw
  modified_base (261)..(261): a, c, t, g, unknown or other
  misc_feature (261)..(261): n is a, c, g, or t
tcagtcgatcacgtcacgaccggtgctcgatttagagagagtgtgttgagtctgggagacttggtagagcctggcaggtccctgagactctcctgtgcagcctctggattcaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagcnccctgtatctgcaaatagaacagtctgagacctgaggacacggccttctatttctgtgcaaaaaaaggcccggtactggcgagtagctaaagagttctttgtactcctggggccgacgggaccgggtcaccgtctcctcacgcctccaccacgggcccactccgtccttccccgtcggccgcccgtcgccgtccacggacgccgaccctccgacgacgccgaccgacgccggcccgtcggggccgtcggcccgtcgggtccgaacggaccgttaccgttcccaccgtcgactccggacctcggaacggtccgggg

SEQ ID NO: 339010 - DNA, 566 bp, Homo sapiens
  misc_feature: GZ8MTXP01A2P6S.38.53.E09.1.454.CMB.2.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagacttggtagagcctggcaggtcccctgagactctcctgtgcagcctctggattcaaattangataatgccatgcacgtggggtcccaanaaggctccgaagggggaacgggcctgggaggtgggtctcgaagtgttagtcggaacnggtggtaccagtagccctaatggcggactcgtgggtagaacggggtccgattcaccatcnccagagaacaacgccaagngcctccctgtactctgacaaatgaacagtctagacgtaccgtgaacgcaacggtccttctattcgtgtgaccgaaaacggttccccggtaagtggcctaggtacgttacgtaagaagggtttccg

SEQ ID NO: 339011 - DNA, 615 bp, Homo sapiens
  misc_feature: GZ8MTXP01BIQHF.38.53.E09.1.454.CMB.2.raw
  modified_base (194)..(194): a, c, t, g, unknown or other
  misc_feature (194)..(194): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacngtggtaccatagcctatgcggactctgtgaagggccattcaccatctccaganacaacgccaagagctcccngtatctgacaaatgaacagtctgagacctgacggacacggtccttctatttctgtgcaaaacggccccgtatcggcagtagctaagagttctttgactccgtggggccgacggggaacccggtcaccgtctcctcacgcctccaccgtaacgggccctagtccggtccttcccccgcggccgccccgtcggggcccttccgacgggacgccgacccgtccgacgaacggccaaccgacgcccggcccgtcggggccttcggtccttcgggtaccgtaaacgggttacccttaaccgttcccgtaacgttacgaacgttaccggacgttcggtaacgggccgggtccggg

SEQ ID NO: 339012 - DNA, 694 bp, Homo sapiens
  misc_feature: GZ8MTXP01E3IOG.38.53.E09.1.454.CMB.2.raw
  modified_base (216)..(216): a, c, t, g, unknown or other
  misc_feature (216)..(216): n is a, c, g, or t
  modified_base (278)..(278): a, c, t, g, unknown or other
  misc_feature (278)..(278): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtggggganacttggtagagcctggcaggtccctgagactctcctgtgcagcctctggattacaaattaangaataatgccatgcacgtgggtcccacaagcctaccgaagggggaacgggccgtgggaaggtggggtcctacgtaaaggttggtttaaggttacgggaaacctaggttacggggtaaacccagtaaacggcccttaagtcggaccgggtacttcgtagggtagggaaacggggcccgtattaccaccatcctaccgagaacgaacgaaacgacccaaagacgaccttaccccgtagtaacgtcctaggaaccaaaagtacggaaactagtaccgtagaacggtaaccctagggaacggaccgtaaccgggtcccttttacttaactttccgtagttacggaaccggaaaaaccgggttcccccggtaagtcgggaaccgtaaggtacggacgttaaagggttaacggttttaaccg

SEQ ID NO: 339013 - DNA, 809 bp, Homo sapiens
  misc_feature: GZ8MTXP01BRMC0.38.53.E09.1.454.CMB.2.raw
  modified_base (283)..(283): a, c, t, g, unknown or other
  misc_feature (283)..(283): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggctattttaaaggtgtccagtgtgaagtgcagctggtggagtcgtgggggatacgttggtagagccgtggcacggtccctgacgactctcctgtgcagcctcgtggtattactaaattangaactaatcgaccatcgctacgtcgggtacccgaacgaacgccgtaccggaagggggaacgggtccgtagggtaggttcggggtccttagtaaaggttggtttaaggtttacgggaaacgtaggttacggtaaccctaagttaacgacccttaagtcgggtacccgggtacttccggttagggtacggggaaacgggggtccccgttaaactttacccgaacccgtaaacttcccgtaaccccgaaagggaaacccgaaaacccgaaacccggtaaccccgaaaacggggacccgtacccctttacccccgttaaggttaaccgtttaccgttaacggaaaccctaaaagttacggaaaaccctaggttaccgttaacgggaaccgtaacccgttagggaaaccggtacccgtaacccgggttcccttttacttacgtttcgtacggttaccgaaaccggaaaccgggttccccggtaagtcgggaaccgtaaggtacgttaccggttaaggttcggttttaaccg

SEQ ID NO: 339014 - DNA, 737 bp, Homo sapiens
  misc_feature: GZ8MTXP01C547C.38.53.E09.1.454.CMB.2.raw
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagtcgatcacgtcacgaccggtgctcgatttagagagagtgtgttgggtttgggggaagaggaagactgacggtcctgccacaggtggtgctgggcacggtgggcactcgacacaacatttgcgctcaactgtcttgtctcaccatggagttgggactgagctggtattttcctttggcttaattttaaaaggtgtccagtgtgaagtgcagcgtgggtggagtcgtgggggatacgttggtagagccgtggcagggtccctggagactctcctgtgcagcctntggattacaaaatttangaataatgaccatgactacgtggggtacccaanaagccgtaccggaaggggaacggctagggagtcgggtctagtaaaggttgtaaggtaagggaaactggttacggaacctaagttaacgcccgtaagtcgaccggtaaccttcgtagggaacggaaacgggccctaattttcccgaaaccctaagttcccgaaccccaaaggggaaaccgaaaccaaaacccgggacccttaaaaaggggccgttaccccgtttccccttaaggtaaccctcggttaaacgaaacgtaaaacgtaacgtaaacgtaacgtacgtaacgtaacggaaccggtaacggaacggtaaccgtaaccgttaccgtttaccgtttacgtttaacgttacgtaacgtaaccggtaaaccgggttaacccggtaacggttaacggtaacg

SEQ ID NO: 339015 - DNA, 599 bp, Homo sapiens
  misc_feature: GZ8MTXP01C4WBE.38.53.E09.1.454.CMB.2.raw
  modified_base (278)..(278): a, c, t, g, unknown or other
  misc_feature (278)..(278): n is a, c, g, or t
  modified_base (492)..(492): a, c, t, g, unknown or other
  misc_feature (492)..(492): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggcttaattttaaaaggtgtccagtgtgaagtgcagctgggtggagtcgtgggggagacttggtagagcctggcaggtccctgagactctcctgtgcagcctctggattcaaattangataatgaccatgcactgggtccgacaagctccgaggggaacgggccgtgggagtggggtctcgtaaggttgttagttaggaactaggtggtaccagtaacgcctaatggcgggtacttcgtgtacggaacggggcccgtattcgacccatcctaccaagaacgacaaaccgaccaaagtacgctaccctgttactctagaccaaatgaaaccngtctagacgtaccctaggacggaccgaaccggtctttacgttatttcgtagtcgaacgaaaacgggttccccggtaagtggctaagtagacgttaagaaggttttcc

SEQ ID NO: 339016 - DNA, 668 bp, Homo sapiens
  misc_feature: GZ8MTXP01B1DQ1.38.53.E09.1.454.CMB.2.raw
  modified_base (549)..(549): a, c, t, g, unknown or other
  misc_feature (549)..(549): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagctctcctgtgcagcctctggattacaaattaatgaataatgaccatgctacgtcgggtacccgaacaagtcctacccggaagggggaacgggggtcccgttagggggaacggttcgggggttccttacggtaaaggtttggtttaaggtttaccgggaaacctaggttcgggtaaccctagttaacgcccttaagtcggaccgggtactcgtggtaggaaacggggccgtattcaccatcctaccgagaacgacaaccgaccgaaagacgtcctccctagtactctacgacaaagtacgaaccngtcctagacgtaccgtaggacgcaacggtcctttcgttactttcgtaggtacgaccgttaaaaccgggttccccggtaagtcgggaacctaggtacgttacgttaaggttcggttttcg

SEQ ID NO: 339017 - DNA, 543 bp, Homo sapiens
  misc_feature: GZ8MTXP01DRWKC.38.53.E09.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (319)..(319): a, c, t, g, unknown or other
  misc_feature (319)..(319): n is a, c, g, or t
  modified_base (441)..(441): a, c, t, g, unknown or other
  misc_feature (441)..(441): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagtggaacagtggtaccatagcctatgcggactctgtgaaggccattcaccatcnccaaganacaacgccaagagctcccngtatctgacaaatgaaacagtctagagacctgacgacacggcctttctatttcngtgacaaacggcccgtatcggcagtagctaagaggttctttgactccgtggggccaacggggacccgggtcaccgtctcctcacgcctccaacgaacgggccctagtccggtccttccccgngccgccctgggcctccgagcgccacctcgagacncaacngccggccctgggcngccgttgtacaaggacttcgttccaagtgaactcgacttggcgcgggtc

SEQ ID NO: 339018 - DNA, 760 bp, Homo sapiens
  misc_feature: GZ8MTXP01DW2VZ.38.53.E09.1.454.CMB.2.raw
  modified_base (282)..(282): a, c, t, g, unknown or other
  misc_feature (282)..(282): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacttgggtagagcctggcaggtccctgagactctcctgtgcagcctctggattacaaattangataatgcctatgacacgtcgggtaccgaacaaggccctaccggaagggggacgggggcccgttagggggaaggttcgggggttccttacggtaaaggttggtttaacggtttacgggaaacctagggttacggtaaccctagtaacgcccttaaggtcgacccgggtacttcgtgggtacgggaaacggggtcccgtagttccaaccgtataccgtaccgaagaacgaaccaaaccggaccaaacggtacgtaccttcccttaggttaacttcccgtaggtaaacctaaacgtagaaaccgtacgttacgtacggtaaacgtacccgttagggaaaccggaccgtaacccgggttacccttttacgtttaaccgtttttcgtacggtttacgaaacccgggttaaaaccggggttacccccggttaaggttacggaacgtaaggtacggttacgttaaaggttcgggtttttaaccg

SEQ ID NO: 339019 - DNA, 573 bp, Homo sapiens
  misc_feature: GZ8MTXP01BWY6L.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagtggaacagtggtaccatagcctatgcggactctgtgaaggccattcaccatctccagagacaacgccaagagctccctgtatctgacaaatgaaacagtctgagacctgaggacacggtccttctatttctgtgacaaaacggccccggtatcggcagtagactaagtaaggttctttgactccgtggggccacggggaacccgggtcaccgtctcctcacgcctccaccgaacgggcccagtccggtccttccccgtcgccgccctggcctccgaggacgccacctccggagacgcaccgacgccggcccgtcgggcttcggcccgttgggtaccaagggttaccttcttcccgaacgttgaacttcgacgttgaacggcgggtcg

SEQ ID NO: 339020 - DNA, 688 bp, Homo sapiens
  misc_feature: GZ8MTXP01B0C51.38.53.E09.1.454.CMB.2.raw
  modified_base (287)..(287): a, c, t, g, unknown or other
  misc_feature (287)..(287): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaatttaaaggtgtccagtgtgaagtgcagctggtggagtcgtgggggatacgttggtagagccgtggctaggtccctgacgtactctcctgtcgcacgcctcgtgtattactaaattanagataatcgccatgctacgtgggtacccacgaagccgtaccggaagggggacgggtccgtagggaggttcgggtactacgaaaggttggttacggttaggaacctaggttacggtaacccagtaaacgtcctaagtcgaccggtctcgtaggtacgggaacgggtcccgtacttaccgacctactacccgtaccgaagaaccgaaccgaaaccgaccgaaacggtaccgtcctaccgttacgtaactcgttacgaacctaaagttacgaactacgtacgtacgacgtacccgaggaccggtccgtaacggttccttattacttcgtacgtacgaacgggttaaaaccgttccccggtaagtccggaacgtaggtacgttaacgtaacggttcgtttaaccg

SEQ ID NO: 339021 - DNA, 576 bp, Homo sapiens
  misc_feature: GZ8MTXP01B00WC.38.53.E09.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (443)..(443): a, c, t, g, unknown or other
  misc_feature (443)..(443): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaaggccattcaccatctccagagacaacgccaagagctcccngtatctgacaaatgaacagtctgagacctgagacacggtccttctatttcngtgacaaaacggcccgtatcggcagtagctaagtaagttctttgactcgtggggcacggggacccggtcaccgtcctctcacgcctccaccgaacggccctacgtccggtcccttccccgcggccncccctgggccctccgaggcgccacccgtccgagacgccacgacgtccggccctggggcttcggaccgttgggtaccaacgggttaccttccgttcccgaacgtgtaacttccggagttcggaacggcgggtcg

SEQ ID NO: 339022 - DNA, 576 bp, Homo sapiens
  misc_feature: GZ8MTXP01BKMLF.38.53.E09.1.454.CMB.2.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
  modified_base (460)..(460): a, c, t, g, unknown or other
  misc_feature (460)..(460): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctatttaaaggtgtccagtgtgaagtgcagctggtggagtcgtgggggagacttgggtagagcctggcaggtccctgagactctcctgtgcagcctctggattcaaattangataangccatgcacgtggccacaagctcgaggggaggctgggagtgggtctgaagtgttagtcggaacngtggtaccagtaacgcctaagcgcggtactcgtggtagaacggggcccagttccaccagtctaccagaacgacaaacgccaaagacgcctacctgtatcgtgactaaatcgaacngtccgtagacgtacctaggacggaccgtaacggtccttacgtactttcgacggttgaacgaaaaccgggttccccgtaagcggtaaccaggtacgttacgttaagggttcgtttcg

SEQ ID NO: 339023 - DNA, 728 bp, Homo sapiens
  misc_feature: GZ8MTXP01A2QBD.38.53.E09.1.454.CMB.2.raw
  modified_base (287)..(287): a, c, t, g, unknown or other
  misc_feature (287)..(287): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaagttttaaaaggtgtccagtgtagaagtgcagcgtggtggagtcgtgggggatacgttggtagagccgtggcaggtccctgagactctcctgtgcagcctcgtggattactaaattanagtataatgccatcgacacgtcgggtaccaacaaggccgtaccggaagggggaacgggtcccgtagggtaacggttcggggttactacggtaaaggttggtttaacggttaggaaacctaggttacgggtaaccctagttaaacggacccttaagtcggtaccgggtacttaccgtggtacggggaaaccggggtccctaactttcccaaccctactccctacccgaagaaccgaaccgaacgacccaaaggaccgtcccttacccgttgtaacttacgtacggaacctaaagtcggaaacctgttaccgtaggaacgtacccgtaggaccggtaaccgtaaccggttcctttacgttaacttttcgacggtacgaaaccggttaaacgggttccccgtaagtcggaacgtagtacggttacgttaaggttcgtttaaccg

SEQ ID NO: 339024 - DNA, 698 bp, Homo sapiens
  misc_feature: GZ8MTXP01DWJBL.38.53.E09.1.454.CMB.2.raw
  modified_base (293)..(293): a, c, t, g, unknown or other
  misc_feature (293)..(293): n is a, c, g, or t
  modified_base (517)..(517): a, c, t, g, unknown or other
  misc_feature (517)..(517): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaagttttaaaaggtgtccagtgtgaagtgcagcgtggtggagtcggtgggggagtacgttgggtagagccgtggcacggtccctgagactctcctgtgcagcctcgtggtattactaaattaangtaataatgccatgcacgtcgggtaccgacaacgccgtaccggaagggggacgggccgtgggtaaggtcgggttctacgtaaggttgttaggttacggaactaggttacggtaacctagtaaccgtaccttaagtgggacccggtacttcgtagggtagggaacggggtcctacgttccacctactcctaccgaaggaacgaaccaaaccggaccaaaggaccnccttaccgtcgtacttacgtcgaacctaaatacgaaacgtagtcgtaagacgtaccgtaggacgaccgtaaccgttccttactttacgtttcgtacggttcgaaaccggttaaaccgggttccccgggttaagtacggaacgttaaggtaccggttaacgttaagggttaacgttttccgg

SEQ ID NO: 339025 - DNA, 594 bp, Homo sapiens
  misc_feature: GZ8MTXP01EZKBK.38.53.E09.1.454.CMB.2.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccaggggaagggcctggagtgggtctcaagtgttagttggaacngtggtaccatagcctatgcggactctgtgaagggccattcaccatctccaganacaacgccaagagctcccngtatctgcaaatgaacagtctgagacctgaggacacggccttctatttctgtgacaaaacggccccggtatcggaccagtagctaagaaggtttcttgactcgtggggccacggggaaccgggtcaccgtctcctcacgcctccaccgaacgggcccacgtccgggtccttccccctggcccgccctcggctccgaggacgccacccgtccgagacgcacgacgccggcccgtcgggcttcggcccgttggtaccgaaacgggttaccttaccgttacccgaaccgtcgaacgttccggaacttcgggtaacgggccgggtccggg

SEQ ID NO: 339026 - DNA, 692 bp, Homo sapiens
  misc_feature: GZ8MTXP01BM5S3.38.53.E09.1.454.CMB.2.raw
  modified_base (218)..(218): a, c, t, g, unknown or other
  misc_feature (218)..(218): n is a, c, g, or t
  modified_base (280)..(280): a, c, t, g, unknown or other
  misc_feature (280)..(280): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtggggganacttggtagagccgtggcaggtccctgagactctcctgtgcagcctctggattacaaattangaataatgccatgcagtggccacagctcgagggaggctggagtggtctgaagtgttagtaggaactagtcggtaaccagtaacgccctaagtcggccgggtaacttcgtaggtacgggaaacgggcccgtatttccaacctatcctaccgaaggaacgaaccgaaccggacccaaaggacgtcccttaccccgttaggttaactacgttacggaacctaaaagttcgaaaacccgtagttaccgttaggaacgtaaccccgttagggaaccggtaacccgtaaccgggtttcccctttaactttacgttttaccgtaggttaaccggttaaaccggaaaaaccggggttcccccgggttaagtacggggaaccttaaggtacggttacgttaaagggttcggtttttaaccg

SEQ ID NO: 339027 - DNA, 739 bp, Homo sapiens
  misc_feature: GZ8MTXP01D1Y5Q.38.53.E09.1.454.CMB.2.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggganacttggtagagcctggcacggtccctgagactctctgtgcagcctctggattacaaattangataatgccatcgacacgtcgggtccaacaagcctaccggaagggggaacgggtccgtgggaggtcgggtactacgtaaaggttggtttaaggttcggaaactaggttacggtaaacccagtaacgacccttaagtcggaccgggtaacttcgtagggtacgggaaacggggtcccgtaactttcgaaccctactacccgttaccgaaggaaaccggaacctaaaccgggacccaaagggactccctacccgttagtaacttccgtagaaccctaaagttacgaaacgtacgttcgaacggtaaccgtacccgtaaggaccggtaacccgtaacccgggttcctttacgtttaacgttttcggtaacggttcggttaaaacccggttaaaacccgggttccccgggtttaagacccggggtaataacggaggttaccgttaaaggttcggttttaaccgg

SEQ ID NO: 339028 - DNA, 766 bp, Homo sapiens
  misc_feature: GZ8MTXP01AV6QV.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagtacgttggtagagccgtggcacggtccctgagactctcctgtcgcacgcctcgtggtattactaaattaatgtaataatcgacctatcgcgtacgtcgggtacccgaacaacggtccgtaccggaagggggaacgggtccgtgggaggtgggggtctacgtaaggttggtttaggtacggaaacgtagggttacggtaaccctaagtaaccggtcccttaaggtcgggtaccggtacttcggtagggtacgggaacggggtccctattaccgacctactccgtaccgaaggtaaccgaaccaaaccggaccgaaacggtccgtacccgttacccgttagttaacttacgtaacgtaaaccaaaagttaccgaaaaccgtgttacaacgggtacgtaacccgttagggaacccggaccggtaacccggtttccctttacgtttacgttccgttacgggtaacggttaaacccggttaaaccgggttccccgggttaagtccggaacggttaaggtacggttaacgtaagggtttcggttttaaccgg

SEQ ID NO: 339029 - DNA, 645 bp, Homo sapiens
  misc_feature: GZ8MTXP01D2AVC.38.53.E09.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (512)..(512): a, c, t, g, unknown or other
  misc_feature (512)..(512): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagcgtgggtggagtcggtggggganacgttggtagagccgtggcacggtccctgacgactctcctgtcgcacgcctcgtggtattactaaaattaangtaataatcgccagtcgcacgtcgggtacccgaacaacgcctaccggaagggggaacgggtccgtagggacggttggggtcttacgtaaggttgtttaacggtacggaaactaggttacggtaaccctagtaacgccttaagtgaccgggtacttcgtggacgggaacgggtccctattccacactcctaccaaggaacgaccaaacgcctaaaggcnccttacccgtagtactctgaaacctaaatcgaaacctgtctaggacaccgtggacgaacgaaccgtctttctattcgagtacgaccgaaacggttcccgtaagtgaactagtacgacgttaagttggtttccg

SEQ ID NO: 339030 - DNA, 608 bp, Homo sapiens
  misc_feature: GZ8MTXP01BSTS7.38.53.E09.1.454.CMB.2.raw
tcagtcgatcacgtcacgaccggtgctcgatttagagagagtgtgttgggtctggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaaggccattcaccatctccagagacaacgccaagagctccctgtatctgacaaatgaacagtctgagacctgacggacacggtcctttctatttctgtgacaaaacggccccggtatcggcagtagactaaggtaggtttctttgactccggtggggaccacggggaaccccgggtcacccgtctcctcacgcctccacgaacgggccctacgtccggtccttccccgtcggcccgtccccgtcggcctcccgacgggacgaccacccgtccgacgacgccacgacggtccggcccgtggggccttcggccgttgggtaccaacgggttaccttaccgttcccgaacggtcgtaacgtccggacgttcggaacggcggggtaaccg

SEQ ID NO: 339031 - DNA, 673 bp, Homo sapiens
  misc_feature: GZ8MTXP01DEWA3.38.53.E09.1.454.CMB.2.raw
  modified_base (502)..(502): a, c, t, g, unknown or other
  misc_feature (502)..(502): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctgggtggagtcgtgggggagtacttgggtagagcctggcaggtccctgagactctcctgtgcagcctctggtattactaaattaatgataatcgaccatcgactacgtcgggtacccgaacaagccgtaccgaagggggaacggggtccgtggggtaggtcgggggtcttacgtaaggttggttaaggtttaggaactaggtcggtaacccataacgaccttgtgccggtactcgtagtacgggaaacggggtcccgtattccaacctactcgtaccgaagaacgacaaccgaccaaggacnccttcccgtagtactcgtagaactaaatgaaacgtgtaccgtaggaacgtaccgtaggacggaaccgtaaccggtcctttacgttactttcgtcgttacggaaaccggttaaaccgggttaccccgtaagtacgggaactacggtagttacgttaaaggttcggttttccg

SEQ ID NO: 339032 - DNA, 790 bp, Homo sapiens
  misc_feature: GZ8MTXP01BI558.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggagacgttgggtagagcctggcaggtccctgagactctcctgtgcagcctctggtattactaaaattaatagaattaaatcgaccctaatcggacctacggtcggggtacccgaacgaaacggccgtaccggaaagggggaacgggcccgtaggggacggttcgggggtacttacgtaaaggttcggtttaaggttacggaaactaggttacggtaaccctaagttaacgacccttaagtcggtaccgggtaaccttcgtagggtacgggaaacgggggtaccctaactttaccgaacctaactccgtacccaaaggaaaccgaaaccgaaaccggacccgaaacgaccgtacccttacccgttacggttaacttcgttaacggaaacctaaaagttaacgaaaccgtacgttacgtaacggtaacgtacccgttacgggaaccggtaaccgtaaccggttccctttacgtttaactttcgtacgtacggaaaccggttaaaaccgggttccccggttaagtccgggtaacgaaggttacgttaacgggttaaggtttcgggttttaaccgg

SEQ ID NO: 339033 - DNA, 700 bp, Homo sapiens
  misc_feature: GZ8MTXP01C51QQ.38.53.E09.1.454.CMB.2.raw
  modified_base (279)..(279): a, c, t, g, unknown or other
  misc_feature (279)..(279): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacttggtagagcctggcaggtccctgagactctcctgtgcagcctctggattacaaattangataatgcctatcgctacgtcgggtacccgaacaaggcctaccggaagggggaacgggtccgtaggggaggtggggttaccttacgtaaggttggtttaggttacggaaacgtaggttggtaacccagttaacgcccttaagtcgaccgggtacttcgtggtacggaaacgggtccgtagttaccacctactccgtaccgaagaacgaaccaaaccgacccgaaagaccgtaccttacccgttagttacttactaggaactaaacgttacgaaacgtacgtacgtacggaaccgtaaccgtaggaccggtaaccgtaaccgggttccctttacgttactttccgttaggttacgaccgttaaaaccgggttccccgtaagtcggtaacgtagtacgttacgttaaggttcggttttaaccg

SEQ ID NO: 339034 - DNA, 593 bp, Homo sapiens
  misc_feature: GZ8MTXP01EBYXD.38.53.E09.1.454.CMB.2.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccaggggaagggcctggagtgggtctcaagtgttagtggaacagtggtaccatagcctatgcggactctgtgaagggccattcaccatcncagagacacgccaagagctccngtatctgacaaatgaacagtctgagacctgagacacggccttntatttctgtgacaaaacggccccgtatcggcagtagctaaagaggtttactttgacctcgtggggaccaggggacccggtcaccgtctcctcacgcctccaccgaaacgggccccaagttccgggtcccttcccccgngggccnccccttggggccctcgacgggaacccgccacccgacgagacgccacgaccggtcccggccgtcggtcgttccgtccgttacggtaacgtaaccgttaccttaccgttaccgaaggtcaacgtaccgagcggtcggcgggtcg

SEQ ID NO: 339035 - DNA, 646 bp, Homo sapiens
  misc_feature: GZ8MTXP01EFZ49.38.53.E09.1.454.CMB.2.raw
  modified_base (277)..(277): a, c, t, g, unknown or other
  misc_feature (277)..(277): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaattangataatgccatgcatgggtccacaagctccgaaggggaggccgtggagtggtctcaagtgtagtcgacagtgaccagtaacgctaatgcgtactcgtgtaggaacgggccgtattccgacctagtcctaccaagaacgaaccgaaaccggaccaaacgaacgtcctacccctaggtactctagacctaaaatcgaaacgacgttaccgtaggaacgtacccgttaagggaacggtaaccgtaaccggttccctttcttaaacgttttccgttacggttacggaaaccggttaaaaccggggttacccccggttaagtcgggtaaccgtaagggtacgttacggttaaacgggttcggtttttaacccgg

SEQ ID NO: 339036 - DNA, 738 bp, Homo sapiens
  misc_feature: GZ8MTXP01BTTU8.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacgttggtagagccgtggcaggtccctgagactctcctgtgcagcctctgattacaaattangaattaatgccatgcacgtgggtaccgacaagcctccgaagggggaacgggccgtagggaggttcggggtactacgaaggttggtttaaggttacggaactaggttcgggtaaccagttaacgcccttaagtcggcggtactcgtggtagggaacgggccctattccgacctacgtcctaccgaagaacgaaccaacgaccaaagacgtccctacccgttgtaacttcgtacgaacctaaagtacgaaacgtacgttcgaacggaacggtaacccgttgggaaaccgggtaacccggtaacccggtttaccccttttacgtttaaacgtttttcccggtaagggtttaccggaaacccgggttaaaaaaccggggttcccccgggtttaagtaccggggtaaccgttaaaggggttacggttaaccgtttaaaaggggttaacggtttttttcccgg

SEQ ID NO: 339037 - DNA, 657 bp, Homo sapiens
  misc_feature: GZ8MTXP01ET14J.38.53.E09.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (459)..(459): a, c, t, g, unknown or other
  misc_feature (459)..(459): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtgggggatacgttggtagagccgtggcgacggtccctgacgaccttctcctgtcgcagcctntggtattactaaattangtaataatcgacctatcgcctacggtcgggtacccaacgaacgccgtaccggaaggggaacggggtcctaggggtaggttcgggtactacgtaggttgttaggtacggaactaggtacgtacagtacgctgtcgacgtactcgtgaggacgggtcctattcgacctntctacgaagacacaacgaccaagcgcctcgtagtactctagaactaagtacgaactgtacgagacgtaccgtaggaaccggtccgtaaccggtttcctttacgttaacgttttcgacggttaacgaaaccggttaaaacccgggttcccggtaagtacggaaccgttaaggtcgttacgttaaggttaacggtttccg

SEQ ID NO: 339038 - DNA, 734 bp, Homo sapiens
  misc_feature: GZ8MTXP01E0N08.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtgggggagacgttggtagagcctggcaggtccctgagactctcctgtgcagcctctggattacaaattatgaataatgcctatcgcacgtcgggtcccacaagcctaccgaagggggaacgggccgtgggacggtggggtctacgaaggttgtttaggttacggaaactaggttcggtaaacaagtaacggacctaagttcggaccgggtaaccttcgttacgggttaggggaaacgggtacccggtatttacccgaacctaacttccctaccgaagaaaccggaaaccaaaccgggacccaaaggaccgccttaccccgttaggttaactcgttaggaaactaaaacgtacggaaacctacgggttctaagggaccgtaccgttacgggaacgggaacccgtaaccgggttccttttacgttacgttttcgtcggttaacggaaccgttaaaaccgggttccccgggtaagtcgggtaaccgtaaggtacgttaccgttaaaggttcgggtttttaaccg

SEQ ID NO: 339039 - DNA, 716 bp, Homo sapiens
  misc_feature: GZ8MTXP01AQ86Y.38.53.E09.1.454.CMB.2.raw
  modified_base (248)..(248): a, c, t, g, unknown or other
  misc_feature (248)..(248): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggagtacgttggtagagccgtggcaggtcccngacgactcctcctgtgcacgcctcgtggtattactaaattatagtaattaagtcgacctagtcggactacgttcggggtacccgaacgaacggtccgtacccggaagggggaacgggtcccgtaggggtacggttggggttccttacggtaaaggtttcggtttaaggttacgggaaacgtaggttacggtaaccctagtaaacggcccgttaagtcgggtaccggtaacttcggtaggtacgggaacgggtccgtacttaccacctagtcctaccgaagacgaaccacgacgaaagctcctactagtactcgtagtaacaaacgtagaacgtacgtacgtacggacctaccggtaggaccggtacctaaccggttcctttacgttagttccgtaggtaccgaaccgttaaaccgggttcccgtaagtcggaaccgtagttacgacgttaacggttcggtttaacccg

SEQ ID NO: 339040 - DNA, 612 bp, Homo sapiens
  misc_feature: GZ8MTXP01DRGIW.38.53.E09.1.454.CMB.2.raw
  modified_base (218)..(218): a, c, t, g, unknown or other
  misc_feature (218)..(218): n is a, c, g, or t
  modified_base (280)..(280): a, c, t, g, unknown or other
  misc_feature (280)..(280): n is a, c, g, or t
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggcttaattttaaaaggtgtccagtgtgaagtgcagctggtggagtcgtggggganacttgggtagagcctggcaggtccctgagactctcctgtgcagcctctggattacaaattangataatgccatgctactcggggtccacaaaggccctaccgaagggggaacgggcctagggagtgggtactcaaaggtgttagttcggaactaggtgtaccagtaacgcctaagtgacggtacttcgtaggtggaaacggggcccgtattaccaacctatcctaccgaagaacgaacaaaccgccaagaacgcctacctcgttacgtctagaactaaactgaaactgtcgtagacgtacctgacgtacncggtacttnttacttcgtgtcgttacgaaaacgggttccccgtaagtacggctaaggtagttacgttaaggttcggttttaacg

SEQ ID NO: 339041 - DNA, 583 bp, Homo sapiens
  misc_feature: GZ8MTXP01DH1YT.38.53.E09.1.454.CMB.2.raw
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaaggccattcaccatctccaganacaacgccaagagctccctgtatctgacaaatgaacagtctgagacctgaggacacggccttctatttcngtgacaaaacggcccgtatcggcagtagctaagagttcttgactccgtgggccaggggacccggtcaccgtctcctcacgcctccaccgaacgggcccatccggtccttccccgtggccgccctggccctccgaggacgcacccgtccgagacgccacacggccggcccgtgggccttcggcccgttgggttaccgaacgggttaacccttccgtttacccgaacggttacgaacttccggacgttcggtaacgggccggggtccgg

SEQ ID NO: 339042 - DNA, 672 bp, Homo sapiens
  misc_feature: GZ8MTXP01AUCS0.38.53.E09.1.454.CMB.2.raw
  modified_base (282)..(282): a, c, t, g, unknown or other
  misc_feature (282)..(282): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacttggtagagcctggcacggtccctgagactctcctgtgcagcctctggattacaaattaangaataatcgaccatcgcacgtcggggtaccaacaacggcctaccggaagggggaacgggtcccgtgggaaggtcggggtctacgtaaggttagttaggttacggaactaggtcggtaacccagtaacgacctaagtcggcggtactcgtggtacgggaacgggcccgtacttcgaacctagtcctaccgaaagacgaaccgaaacggaccaaaggactcctacccgttagtactacgtacgaactaaacgtacgaaacgtcgtaccgtaggaacgtacccgtagggaacgtaccgaacccggttcctttacgttactttcgtgtacggttaaccgaaaccgggttccccggtaagtcggaacgagtacgacgttaacggttaacgtttcg

SEQ ID NO: 339043 - DNA, 705 bp, Homo sapiens
  misc_feature: GZ8MTXP01DPOFM.38.53.E09.1.454.CMB.2.raw
  modified_base (184)..(184): a, c, t, g, unknown or other
  misc_feature (184)..(184): n is a, c, g, or t
  modified_base (288)..(288): a, c, t, g, unknown or other
  misc_feature (288)..(288): n is a, c, g, or t
tcagtcgatcacgtcacgaccggtgctcgatttagagagagtgtgttggggtttgggggggagaggagccccagccctgagattcccaggttgtttccattcagtgatcagcactgaacacagaggactcaccatggagttgggactgagctggtattttccttttggcttaattttaaaaggngtccagtgtgaagtgcagctgggtggagtcgtgggggagacttgggtagagcctggcacggtccctgacgactctcctgtcgcagcctctgattacaaattaangataatgacctatcgctacgtcgggtacccaataacggccgtaccggaagggggaacgggtccgtagggggtaaggttcggggtacttacgtaaaggttggtttaaggttacggaaactaggtacggtaaccctagtaacgcctaaggtcgacgggtaacttcgtgggacgggtaaacgggtccgtaacttaccgaacctactcctaaccgaagaaacgaaccaaacgaccgaaacgacgcctacccgtaggttaactccgtagaacctaaagtacgtaacgtacgtactaacgacgtacccgtaggacggtaccgtaaccggtcctttacttacgtttcgtacgttacgaaccggttaaaaccggttcccggtaagacggtaacgtagtacgttacgtaacgggttgtttaaccgg

SEQ ID NO: 339044 - DNA, 658 bp, Homo sapiens
  misc_feature: GZ8MTXP01ECRNE.38.53.E09.1.454.CMB.2.raw
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtggggganacttggtagagcctggcaggtccctgagactctctgtgcagcctntgatactaaatangatatgccatgctacgtcgggtaccaacaagcctaccggaagggggaacgggtccgtgggtaggtcgggtacttacgtaaaggttggtttagttacggaaacgtaggtacggtaaccctagtaacgtcctaagtcggtaccggtacttcgtaggtacgggaacgggtccctagttccaacctattccaccgaagaacgaaccaacgacgaaagacgcctacccgtagtactcgtacgaacctaaagtacgaacgtacgtacgtaggaccgtaacccgggaaggtaccgtccggttccctttattacgtttcgttagtacgtaaccgaaaccgggttcccgttagtcggacgtaagtacgacgttaggttcgtttcgtaacgg

SEQ ID NO: 339045 - DNA, 696 bp, Homo sapiens
  misc_feature: GZ8MTXP01CV3PL.38.53.E09.1.454.CMB.2.raw
  modified_base (282)..(282): a, c, t, g, unknown or other
  misc_feature (282)..(282): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtggggatacgttggtagagcctggcaggtccctgacgtactctcctgtgcagcctcgtgattacaaattangatatgaccatgcacgtcggtaccgaacaagcctaccggaaggggacgggtcctagggtagtcggggtctacgtaaggtttgttaggttacggaactaggtcgtaacccagttaacgccttaagtcggaccggtacttcgtaggtacggaacgggtcctagttccactagtcctacgaaggacgaaccaacgaccgaaagccgtccttacccgtagttactaccgtagaacctaaagttacgaaacgtagtcgtaacggacgtaaccgttggaaaccggtaccgtaaccggtttccctttcgtttaaacgttttcggtacgtacggttaaacccggttaaaacccgggttccccggtttaagtcgggaaccgttaaagggtaccgttaggttaaaacgttcgggttttaacccg

SEQ ID NO: 339046 - DNA, 776 bp, Homo sapiens
  misc_feature: GZ8MTXP01B84DH.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttattttaaaggtgtccagtgtgaagtgcagcgtggtggagtcgtgggggagtacgttggtaggacgccgtgggccgacggttcccctggaacgtaccttcctcccgtggtcgccacgtcccgttcgtagggtaatttaactaaaaatttaagtagtaaattaaagttcgaccctaagtcgaccgtaacggttcgggggtaaccccaacgaacggtcccgttaccgggaagggggtaaccggggtccgttaggggtaacgggttcggggttaccttacggtaaaggtttggtttaaggttacgggaaaccgtaggtacggtaacccagttaaacgtcccgttaagtcggtaccggtaccttgtggtaacgggtaacgggtcccgtaacttccgacctactccgtaccaacggaacgaccgaaaccgaccgaacgacgtccttaccgtagtactcgtacgactaaagtacaacgagtacgtacgacgtaccgtgacgacgtaaccggtctttcgttacgttcgtacggtacgttaaaccggttaaaccgggttaccccggtaagtacggaacgttaacggtaacgttaccgttaagggttcggttttaacgg

SEQ ID NO: 339047 - DNA, 676 bp, Homo sapiens
  misc_feature: GZ8MTXP01CHSEF.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttggactgagctggtattttccttttggcttaattttaaaaggtgtccagtgtgaagtgcagctggtggagtcgtgggggagtacgttggtagagccgtggcacggtccctgagactctcctgtgcagctctgattcaaattangataatcgacatgcacgtgggtaccacaagcctacggagggacggccgtgggagtgggtctagtaaggttgttagtcggaaactggtacggtaaccagtaacgacctgtcggaccgtacgtcgtagggtacggaaacggggtccctagttaccaacctacgtcctaccgaagacgaaccgaaaccgacccaaaggccgtaccttccccgtagttaacttccgttaaggaacctaaaagttacgaaacgtacgttacgtaacggacgtaaccccgtaggacggtaacccgtaacggtttaccctttagtttaccgtttacgtaggttaccggaaacgttaaaaccgggttccccgtaagttcgaacgtagtaggttacttaaggttaacgtttccg

SEQ ID NO: 339048 - DNA, 687 bp, Homo sapiens
  misc_feature: GZ8MTXP01AVPU1.38.53.E09.1.454.CMB.2.raw
  modified_base (284)..(284): a, c, t, g, unknown or other
  misc_feature (284)..(284): n is a, c, g, or t
  modified_base (553)..(553): a, c, t, g, unknown or other
  misc_feature (553)..(553): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagacttggtagagcctggcaggtccctgagactctcctgtgcagcctcgtggtattacaaaattaangtaattaaatgcccatgcacgtcgggtcccaacaagcctaccgaagggggaacgggtcctagggaggtcgggtacttacgaaggttggtttacggttaggaaacctaggtacggtaacccagttaaacggcccttaagtcggaccgggtacttccggtgggtagggaaacggggtcccgtaattaccgaacctagttcctaccaagaacgaacaaaccgcccaaagcgtcctcccgttagtactcttacggactaaaagtcgaaaacgngtcctaaggacgtaaccgtacggaacggaccgtaaccggtcctttacttactttcgtacggtacgttaaccgaaaaccgggttccccggttaatcgggtaacctaaggtagaccgttaagttcggttttaaccg

SEQ ID NO: 339049 - DNA, 745 bp, Homo sapiens
  misc_feature: GZ8MTXP01B27FJ.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggatacgttggtagagccgtggcacggtccctgacgactctcctgtcgcacgcctcgtggtattactaaattaatgtaataatcgacctatcgactacgtcgggtacccaacgaacgtccgtaccggaagggggaacgggtccgtaggggtaacggtcgggtcttacgtaaggtttggtttaacggttacggaaacgtaggtacggtaaccctaagttaaaccgtacccttaagtcggaccggtaccttcggtggtaacgggaaacgggccctacgttaccaaccgtactcctaaccgaaggaaacgaaccgaaaccgaccgaaacgacgtacccttaccgtagttacgtcgtaacggaacctaaaacgttacgaaacgtacgttacgtaacggaacgtacccggtaaggaaccgggtaccgtaacccggttcctttacgttactttcgtacggtacgaaccggttaaaacccgggcccggttaagtcggtaacgtacggtacgttaccgttaagggttcgttttaacg

SEQ ID NO: 339050 - DNA, 886 bp, Homo sapiens
  misc_feature: GZ8MTXP01BC525.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtggggggagtacgttgggtagacgccgtgggcgacggtcccctggacgtaccttcctcccgttggtgcctaggtccctcgtggtattactaaaatttaatagaataatcgacctatcgcctaacggttcggggtacccgaacgtaacgccgtacccggaaggggggaacggggtcccgttagggggaacggttcgggggttccttaacggtaaagggtttggtttaagggtttacggggaaaaccgtaggggttacgggttaacccaagttaacggtacccgtttaagtcgggtaaccgggtaccttcggttagggtaacgggtaaacgggggtacccgtaactttacccgaaacccgtacttacccgtaccgtaacgaaaccggaaaccgaaacccggaacccgtaaaggaccgtaaccccttccccgttaacggtaacttacccgtaggaaactaaaacgttaacggaaacctacggttacgtaacggtaaccggtaaccccgtagggaaaccgggacccgttaacccgggtttacccttttactttaacgttttccggtaacgggttaacccgaaaccgggttaaaaccccgggggttacccccgggtaaggttccgggaaccgtaagggtaacgttaccggttaaagggtttcgggtttttaacccggg

SEQ ID NO: 339051 - DNA, 680 bp, Homo sapiens
  misc_feature: GZ8MTXP01DZ9F4.38.53.E09.1.454.CMB.2.raw
  modified_base (286)..(286): a, c, t, g, unknown or other
  misc_feature (286)..(286): n is a, c, g, or t
  modified_base (617)..(617): a, c, t, g, unknown or other
  misc_feature (617)..(617): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagacgttggtagagccgtggcaggtccctgagactctcctgtgcacgctctggtacttactaaattaangaattaatgacctatcgactacggtcgggtacccgaacaacggtcgtacccggaagggggacgggtccgtaggggaaggttcgggtacttaacgtaaggttggttaaggtttaccggaacgtaggttacggtaacccagttaaaccgcccttaaggcgggtaccggtacttcgtaggtaacggggaaacggggtccctattacccgaacctacttcctaccgaagaaccgaaccaaccgaccaaaggctccctaccgtagtactactacggaaacctaaagtacgaaccgtgtacctaggacgccgtagacgacgaacgtcttatctttgngtacgaacgttaaacggcccggtaagtcgaacgtagtagttacgttaacgttaacgggtttcc

SEQ ID NO: 339052 - DNA, 634 bp, Homo sapiens
  misc_feature: GZ8MTXP01EV3QT.38.53.E09.1.454.CMB.2.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (490)..(490): a, c, t, g, unknown or other
  misc_feature (490)..(490): n is a, c, g, or t
  modified_base (511)..(511): a, c, t, g, unknown or other
  misc_feature (511)..(511): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagcgtggtggagtcgtggggganacgttggtagagcccgtggcaggtccctgagactctcctgtgcagcctctggattacaaattangattaatgccatcgcacgtgggtacccanaagcctaccggaaggggacggtccgtgggaggttgggtacttacgaaggttcggtttagttacggaaactaggtacggtaaccagttaacgccttaagtcggaccgtactcgtggtagggacgggtcctattccacctatctacagaacgacaacgccaaagccgctccgtagtacncgttagaactaatacgaaacncgtctacggacgtacctaggaacgaccgtaacggtcctttagtactttcgacggttacgaaccgttaaaccgggccccggttaagtcgggaactaaggtacgacgttaagttcggtttaaccg

SEQ ID NO: 339053 - DNA, 724 bp, Homo sapiens
  misc_feature: GZ8MTXP01BAO3E.38.53.E09.1.454.CMB.2.raw
  modified_base (220)..(220): a, c, t, g, unknown or other
  misc_feature (220)..(220): n is a, c, g, or t
  modified_base (305)..(305): a, c, t, g, unknown or other
  misc_feature (305)..(305): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagcgtgggtggagtcgtggggganacgttgggtagagtcccgtgggacctacggtcccctgacgtactctccgtgtcgcacgcctctggattactaaattatgaataangccatgcacgtcggtccaacaagccgtaccgaaggggaacgggtcgtagggtaggttgggtacctacgtaaaggttgtttacggtaggaaacgtaggtcggttaaacccagttaaacgcccttaagtcgggtaccgggtaacttcgtagggtacgggacgggtacccgtacttacacctactcctaccgaagaacgaacaacgaccaaaggacgtcctacccgtacgttacggtactacgtaacctaaagtaacgaaaccgtagttaccgttaaggaaccgtaaccggtacggaacgggtaccgtaacccggttccgtttacctttaaacgtttcgttacggtacggttaaccgttaaaccgggttaccccggttaagtacggcgtaaggtacgttacgtaaggttcgggttttaaccg

SEQ ID NO: 339054 - DNA, 701 bp, Homo sapiens
  misc_feature: GZ8MTXP01D2D58.38.53.E09.1.454.CMB.2.raw
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcggtggggganacgttgggtagagccgtggcacggtcccctgagacttctcctgtcgcagcctcgtggtattactaaattangaataatgccatgcacgtcgggtaccacaagcctaccggaaggggacgggtccgtagggagtcgggtactacgtaagttgttagtacggaactaggtacggtaaccagtaacgaccttaagtcggtacggtactcgtagggtacggaacggggtaccctattaccacctagtccctaccgaagaacgaaccgaaccgaccgaaagccgtacctaccccgttaggttaacttacgtacgaaactaaaacgttcgaaaaccgttcgttaccgtaggaaaccggtacccgtaggaacccggtaacccgtaaccggttcctttacgtttacgtttcgtacggtaacgaaccggttaaaccgggttccccggtaagtcggaactaggtacgttacgttaaggttcgtttaacg

SEQ ID NO: 339055 - DNA, 614 bp, Homo sapiens
  misc_feature: GZ8MTXP01EUOET.38.53.E09.1.454.CMB.2.raw
  modified_base (195)..(195): a, c, t, g, unknown or other
  misc_feature (195)..(195): n is a, c, g, or t
  modified_base (247)..(247): a, c, t, g, unknown or other
  misc_feature (247)..(247): n is a, c, g, or t
  modified_base (469)..(469): a, c, t, g, unknown or other
  misc_feature (469)..(469): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacngtggtaccatagcctatgcggactctgtgaaggccattcaccatctccaganacaacgccaagacgctccctgtatctgacaaatgaacagtctgagacctggagacacggtcctttctatttctgtgaacaaaacggcccgtatcggctagtagactaaaggtacgtttctttggaccttccggtcggggaccgaacgggggtaaccccgggtcacccgtctaccctcacgccctaccaccgaaacgggccctacgtcccggtccttccccgngccgccctcggctccgaaggcacccaccgtccgagacgccaacgcggccggtcccgtgggcttcggcccgtttgggaccgtaacggaccctttaccgttcccgtaacggtgtaacgttcgaccgttggaacgggcgggtaaccgg

SEQ ID NO: 339056 - DNA, 795 bp, Homo sapiens
  misc_feature: GZ8MTXP01DP0HM.38.53.E09.1.454.CMB.2.raw
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtgggggatacgttggtagagcctggcaggtccctganactctcctgtcgcagcctcgtggtattactaaattangtaataatgacctatcgctacgtcgggtaccgaacaacggcctaccggaagggggtaacgggtccgtagggggaacgggttcgggggttacctaacggtaaaggttaggtttaacggttacgggaaaccgtagggttaccgggttaaacccagttaaacgtacccgttaagtacgggtacccgggtaaactttcggtaggggtaacgggtaaaccgggggtcccgttaactttacccgaaccctacgtccgtaacccgaagtaaccgaaacccgaaacgacccgaaagaccgtcctaccccgttagttactcgtaacgaacctaaagtcgaaacgtgtaccgtagacgtaccgtacggaaccgggtaaccgtaacccggttacctttctttaaacgtttcgtacgggttaacgttaaacccgggttaaaaccggggttccccggttaaggtacgggtaaccgtaaaggttaccggttaaggttaacggttaacgggtttttaacccg

SEQ ID NO: 339057 - DNA, 632 bp, Homo sapiens
  misc_feature: GZ8MTXP01DHJPM.38.53.E09.1.454.CMB.2.raw
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttggtagagccgtggcaggtccctgagactctctgtgcagcctntgtattacaaattangataangcatgcacgtggtaccacaacgcctacgaggggacggcgtgggagtcggtctagtagtgttagtacgactaggtgaccagtaacgctgcgcgtactcgtgtggaacgggcgttacttacactactaccagaagaaccaacgaccaagacgcctcctagtactcgtacgaactaaagtacgtaaacgacgtcgtacggaacgacccgttaggaaccggaccgtaacccggttccttttcgttacttttcgttacgtaaccggtaacggaaaacccgggttcccggttaaacgtgggtaaccgtaacgtaaggtaccgttaaggttaacggtttcgtttaaccggg

SEQ ID NO: 339058 - DNA, 709 bp, Homo sapiens
  misc_feature: GZ8MTXP01ARTG7.38.53.E09.1.454.CMB.2.raw
  modified_base (219)..(219): a, c, t, g, unknown or other
  misc_feature (219)..(219): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtggggganacgttggtagagcctggcaggtccctgacgactctcctgtcgcagcctctggattactaaaatttagtagtaattaatcgacctagtcggctaacggttacggggtacccgaaacgaaacgtccgtacccggaagggggtaaaccggggtcctagggggtaacggttcggggtacttaacgtaaagggtttggtttaaaggttaccgggaaacgtagggttacggtaacccgtaagttaaacgacccgttaagtcgggtccgggtaacttcgttagggtacgggaaacgggtccgtacgttacacctacgtcctacgagaacgacaacgacgaacgacgtcctaccgtagtactcgtagacaaacgtagaacgtgtacgtagtacgaccgtaggacgaccgtaaccggtctttcgtacgtttcgtacggtacgaccgaaacgggccccgtaagtcggcgtaaggtacttagtaacggttaacggtttccg

SEQ ID NO: 339059 - DNA, 651 bp, Homo sapiens
  misc_feature: GZ8MTXP01DHH9W.38.53.E09.1.454.CMB.2.raw
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtggggganacgttggtagagcctggcaggtccctgagactctcctgtgcagcctntggattacaaattangataatgccatcgctacgtcgggtacccacaagccgtaccgaagggggaacgggccgtagggacggtggggtcctacgtaaggtgtttaggttacggaacaggtacggtaaccagtaagccctaagtgccgggtactcgtggtaggaacgggccgtacttcaccatctaccgaagaacgaaccaacgacccaaagacgcctccctagtactcgtagaacaaatagaaacagttactagaacgtaccacggacggtaacctaacggtccctttacgttaactttccgtaggttacgaaaccggttaaaaccgggttccccggtaagtcggtaaccgaggtaagttacgttaaaggttaacggttttccg

SEQ ID NO: 339060 - DNA, 647 bp, Homo sapiens
  misc_feature: GZ8MTXP01C1J7S.38.53.E09.1.454.CMB.2.raw
  modified_base (501)..(501): a, c, t, g, unknown or other
  misc_feature (501)..(501): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagacttgggtagagcctggcaggtccctgacgactctcctgtgcagcctcgtggtattactaaaattatgaataatgacctatcgactacgtcggggtacccaacaacgcctacccggaagggggaacgggtccgtaggggtaggtcgggttactacgtaaaggttggtttaggttacggaaacgtaggtggtaacccagtaacgcctaagtcggacggtacttcgtggtaggaacgggccgtattaccgacctatcctaccaagacgaacaacgaccaagacncctacccgtagtactctacgacaaatagaactgtacgtagacgtaccgtagacggaacctcggttcttacttactttccgtaggtcgaaaccgttaaacgggttcccgtaagtcgaacgtagtacgttactaaggttaacgtttcg

SEQ ID NO: 339061 - DNA, 759 bp, Homo sapiens
  misc_feature: GZ8MTXP01AC6Q2.38.53.E09.1.454.CMB.2.raw
  modified_base (271)..(271): a, c, t, g, unknown or other
  misc_feature (271)..(271): n is a, c, g, or t
  modified_base (283)..(284): a, c, t, g, unknown or other
  misc_feature (283)..(284): n is a, c, g, or t
  modified_base (288)..(288): a, c, t, g, unknown or other
  misc_feature (288)..(288): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggaggtcgtgggggagtacgttggtagagccgtggcacggtccctgagtactctctgtgcagctntgatataaatannatangcatgcacgtcggtaccaacgacgccgtaccggaagggggaacgggtccgtaggggtaggtcgggtactacgtaaggttggtttaggttacggaacgtaggtacggtacccaagttaacgtaccgttaagtcggaccgggtacttcggtagggtacgggaacggggtaccctacgttaccaacccgtactcctaccgaagaaccggaacctaaaccgaccgaaacggactacccgttccccttaggtaccttcgtaacggtaacctaaaagttacggaaacctacggtttcgtaacgggaaacgtccccgtaagggaaccggaaccgtaaccccgggttcctttttaacgttacgttttacggtcgttaacccgggttaaccggttaaaacccggggttccccggtttaagcgggtaacccgaaagggtttacggttaccgttaaaacggggtttcggtttttaacccggg

SEQ ID NO: 339062 - DNA, 738 bp, Homo sapiens
  misc_feature: GZ8MTXP01DEUHC.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcacatggagttgggactgagctggtatttttccttttggcttaattttaaaaaggtgtccagtgtgaagtgcagctggtggagtcgtgggggagacttggtagagcctggcaggtccctgagactctcctgtgcagcctctggattcaaaattaatgaataaatgccaatgcacgtgggtacccgaacgaaagctacccgaagggggaaacggggccctggggaaggttgggggtcctagaaaggttgttaaggtttaggaaacaggttcgggtaacccaagttaaacggcccttaatcgggacggggtaaaccttcgtggttaggggaaacgggggtcccctaatttcccaacctaaactccttaccccgaaggaaacgaaccaaaccgacccgaaaaagttcgaccttccccttagttaactcgtaggaccaaaattaggaaacccaggttacctaggaacgacccgttggaacgggaaccctaacgggtcccctttgttaaactttccgttgttaacggaaccggaaaaaaccggggcccccgggtttaaagggtcggtaacgtaacgggttaacgttaacgttaaaacggttaacgggttttaaccg

SEQ ID NO: 339063 - DNA, 661 bp, Homo sapiens
  misc_feature: GZ8MTXP01AZPBG.38.53.E09.1.454.CMB.2.raw
  modified_base (284)..(284): a, c, t, g, unknown or other
  misc_feature (284)..(284): n is a, c, g, or t
  modified_base (513)..(513): a, c, t, g, unknown or other
  misc_feature (513)..(513): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacgttgggtagagccgtggcaggtccctgagactctcctgtgcagcctctggattactaaattangataatgccatgcacgtgggtaccaacaagcctaccgaagggggaacgggccgtagggaggttcggggtactacgaaaggttggttaggttacggaactaggtacggtaacccagtaacgccttaagtcggaccggtactcgtggtaggaacggggcctattccacctatctaccgaagacgacaacgccaaagcgcctacctagtactctagaactaaagtcgaacgngttcgtagaacgtaccgtaggaacgggaacctaaccgggtcctttacgttaacgtttccgtaggttaccggaaccggttaaaaccgggttccccgggttaagtcgggaaccgtaaggtacgttacggttaacggttaacggttttccg

SEQ ID NO: 339064 - DNA, 611 bp, Homo sapiens
  misc_feature: GZ8MTXP01ATOHB.38.53.E09.1.454.CMB.2.raw
  modified_base (218)..(218): a, c, t, g, unknown or other
  misc_feature (218)..(218): n is a, c, g, or t
tcagtcgatcacgtcacgaccggtgctcgatttagagagagtgtgttgggtttggggggggagaggagccccagccctgagattcccaggtgtttccattcagtgatcagcactgaacacagaggactcaccatggagttgggactgagctggtattttcctttggctaattttaaaaggtgtccagtgtgaagtgcagctggtgagtcgtggggganacttggtagagccgtggcaggtccctgagactctcctgtgcagcctctggattctaaattatgataatgccatgctacgtgggtccaacaagcctcgaagggggaacgggtctagggagtgggtcacgtaaggttgtttaacggtggaaactagttaggtaacccagtaacgtcctaagtcgcgggtactcgtggtaggaacgggccgtacttcaaccatccaccgagaacgaaccaacgaccgaagacgtcctacctagtagtctagacaaagtacgaactagtcgagacgtaccgtaggacgacgtaacggtccttcttactttcgacgttacgaacgaaaacgggccccgtaagtcggaacgtagtacgacgttaagttaacggtttccg

SEQ ID NO: 339065 - DNA, 674 bp, Homo sapiens
  misc_feature: GZ8MTXP01BWZ8U.38.53.E09.1.454.CMB.2.raw
  modified_base (283)..(283): a, c, t, g, unknown or other
  misc_feature (283)..(283): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagacttggtagagcctgggcaggtccctgagactctcctgtgcagcctctggtattactaaattangaataatgaccatcgcacgtgggtaccacaagctaccgaagggacggccgtggaggtggtctagtaagtgttagttcggaactaggtgtaccctagtaacgtcctaagtcggaccggtacttcggtaggtacggaaacggggtccctacttaccacctactacctaccgaaggaaccgaaccgaaaccgaccgaacggaccgtccttacccgtaggttacgttcgtacggaacctaaacgtacgaaaccgtacgtcgttacgaacgtaccgtaggtaacggaccgtaaccggttcctttacgttaacgtttcgtacggtacggttaaccgaaaccgggttccccgtaagtcggaacgtaggtacgttacgttaacggttcggttttaaccg

SEQ ID NO: 339066 - DNA, 653 bp, Homo sapiens
  misc_feature: GZ8MTXP01C9E8R.38.53.E09.1.454.CMB.2.raw
  modified_base (287)..(287): a, c, t, g, unknown or other
  misc_feature (287)..(287): n is a, c, g, or t
  modified_base (525)..(525): a, c, t, g, unknown or other
  misc_feature (525)..(525): n is a, c, g, or t
  modified_base (613)..(613): a, c, t, g, unknown or other
  misc_feature (613)..(613): n is a, c, g, or t
tcagtcgatcacgtcacgaccggtgctcgatttagagagagtgtgttggggtttggggggggagaggagccccagccctgagattcccaggtgtttccattcagtgatcagcactgaacacagaggactcaccatggagttgggactgagctggtattttccttttggcttaatttaaaggtgtcagtgtgaagtgcagctgggtggagtcgtgggggagtacgttggtagagccgtggcacggtccctgagactctctgtgcagcctcgtagtattactaaattangaataatgaccatgacacgtcgggtacccgaacaaggccgtacggaagggggaacgggtccgtagggtaggtcggggtctagtaaagttggttaggtacggaaataggtacgtaaccagtaacgacctaagcggacggtactcgtgggtagggacgggctattaccgacctatcctacgagaacgaaccaacgaccaagacgtcctaccgtagtactcgtagaactaaagtcgaaacncggttacaggactaccgtaggaacggtacctcggttccctttgttaacttcgtaacggtacgaaacgttaaaccgggttcccgtaagngtaaccgaaggttcgttaacgttaaggttaacgttttccg

SEQ ID NO: 339067 - DNA, 700 bp, Homo sapiens
  misc_feature: GZ8MTXP01AKR40.38.53.E09.1.454.CMB.2.raw
  modified_base (213)..(213): a, c, t, g, unknown or other
  misc_feature (213)..(213): n is a, c, g, or t
  modified_base (274)..(274): a, c, t, g, unknown or other
  misc_feature (274)..(274): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtggggganacgttggtagagcctggcaggtccctgagactctcctgtgcagcctctggattcaaattangataatgacctatgcacgtgggtccacaagctaccgaaggggaagggcctgggaggttgggtctacgaagttggttacggttacggaacagggtcgtaacccagtaaacgcccttaagtcggcgggtaaccttcgtggtacgggaaacggggcccgtattaccgacccgtaacgttctacccgaagaacgtaaaccgaacccggaccaaacggacgaccgttaccccgttaggtaacttacgttacgaaccgtaaaacgttcgaaaccgtagttacccgtagtaaccgaacccgttagggaaccggaaccgtcgggtaacctttcgttaaactttccgttggtacgttaccgaaaacggttacccccgggtaagttacgggtccgtaaagggtcgttacgttaaacgggttaacgggttttaaccg

SEQ ID NO: 339068 - DNA, 832 bp, Homo sapiens
  misc_feature: GZ8MTXP01BP43H.38.53.E09.1.454.CMB.2.raw
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcggtggggganacgttgggtagacgccgtggccaggtcccctggacgtactctccgtgtgcacgtcctcgtaggtattaactaaattaanagtaattaagtcgacctaagttcgactaccggtcggggtacccgaacgaacggtcccgtaccgggaaaggggggtaacgggtcccgttagggggtaaggtttcggggttacctaacgtaaagggtttcggtttaaggtttaaccgggaaacgttaggttacggtaaccccgtaagtaaccggtcccgttaaggtcgggacccgggtaacttccgggtagggttaacgggaaacggggtcccgtaactttacccgaaaccctaacgttcccgtacccgaaaggaaaccgaaacccgaaaccggacccgaaacggaccgtaccccttaccccgttagggttaactacgttaacggaaacccttaaaagttccggaaaaccgttacggttaccgttacgggaaccgtacccggtacgggtaacggtaacccgtaaccgggttcctttacgtttactttcgacgtacggaaacccggttaaaccggttcccggtaagtcgaacgtaaggtacgttacgtaagggttcgtttaaccg

SEQ ID NO: 339069 - DNA, 629 bp, Homo sapiens
  misc_feature: GZ8MTXP01EW7XT.38.53.E09.1.454.CMB.2.raw
  modified_base (253)..(253): a, c, t, g, unknown or other
  misc_feature (253)..(253): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcgatctgtgaaggcattcacatctcagagacaacgccaagngctccctgtatctgacaaatgaacagtctagacgacctggagacacggtcctttctatttctgtgacaaaacggccccggtatcggactagtagtactaaggtaacgtttctttcgacgtccgtcggggaccgtaacggggaaccccgggtcacccgtcctcctcgacgcctccaccgaacggccctaacgtccggtccttccccgtcggccgtccccgtcggcctccgacggtacgcctacccgcgacgacgccgaacgacgcccggacccgtcgggccttcggtcccgttacgggaccgtaaacgggttaccttacccgttcccgaacggttcgaacgttccgaaccgttcggcggggttaaccgggtcccggg

SEQ ID NO: 339070 - DNA, 721 bp, Homo sapiens
  misc_feature: GZ8MTXP01A51GO.38.53.E09.1.454.CMB.2.raw
  modified_base (220)..(220): a, c, t, g, unknown or other
  misc_feature (220)..(220): n is a, c, g, or t
  modified_base (286)..(286): a, c, t, g, unknown or other
  misc_feature (286)..(286): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttggtagagccgtggcacggtccctgagactctcctgtgcagcctctggattactaaattaangataatcgaccatgcacgtcgggtcccaacaacgcctaccggaagggggaacgggtccgtagggaggttgggtccttacgaaggttgtttaggtaccggaaactaggtacggtaacccagtaacgaccttaagtcgggaccgggtacttcgtaggtaggaaacggggtccctattacccgacctactcctaccgaaggaaaccgaaccgaaaccgacccaaagggacgtcccttaccccgttaggtaactcgtacggaaacctaaaagttccgaaaaccgtagtaccgttaggaaccgtaaccgtacgggtaacggaacccgtaaccgggttcccctttaatttacgtttaccgtaaggttacgaaaccgttaaaaccggggcccccgtaagtcgggaactaaggtacgttaccgttaaaggttaacgttttccg

SEQ ID NO: 339071 - DNA, 734 bp, Homo sapiens
  misc_feature: GZ8MTXP01DV6KZ.38.53.E09.1.454.CMB.2.raw
  modified_base (304)..(304): a, c, t, g, unknown or other
  misc_feature (304)..(304): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaggtgtccagtgtgaagtgcagcgtgggtggagtcggtgggggatacgttggtagagccgtggctacggtccctggacgtactcctccgtggtcgcacgtccttcgtaggtattaactaaaatttaanagaattaagtcgacctagtcgactacggtcgggtacccaacgaacgccgtacggaagggggacggtccgtagggaggtggtctacgtaaggttgttaggttacggaactaggtacggtacctagtaacgtccttaagtcggaccggtacttcgtagggtacgggtaacgggtcctactttaccaaccgtacgtacccgtaaccgaaaggaaacgaaaccgaaccgtaccgaaagaccgtcctacccgttagtactacgtacgaaactaaagtacgaaacgtcgtacgtaagaccgtaaccgtaggaacggtaccgtaaccggttcctttacgttacgtttcgtacggtaacgaaaccgggttaaaccgggttccccggttaagtcggtaacgtaaggtacgttaacgttaacggtttcggttttaaccgg

SEQ ID NO: 339072 - DNA, 574 bp, Homo sapiens
  misc_feature: GZ8MTXP01BSVQQ.38.53.E09.1.454.CMB.2.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (393)..(393): a, c, t, g, unknown or other
  misc_feature (393)..(393): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaaggccattcaccatctcaganacacgccaagagctcccngtatctgcaaatgaacagtctgagacctgaggacacggccttctatttctgtgcaaaaggccccgtatcggcagtagctaagaagttcttgactccgtggggccagggaacccgggtcaccgtctcctcngccctccaccaacgggccccatccggtccttcccccgtggccgcccctggctccgaggacgccacccgtccgacgacgccacgacggccggcccgtggggccttggcccttgggtaccaaggttaccgttcctttcccgaacgttgaacttccggacgttcggaacgttccggggtaaccg

SEQ ID NO: 339073 - DNA, 707 bp, Homo sapiens
  misc_feature: GZ8MTXP01BUSOP.38.53.E09.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggatacgttggtagagccgtggcaggtccctgacgtactctcctgtgcacgcctcgtggtattactaaattanagtaattaancgacctagtcgaccgtacggtacgggtacccaacgaacggtcccgtaccggaagggggaacgggtccgtagggtaggttcgggtactacgtaaggttggttaaggttacggaacgtaggtcgtaacagtaacgcctgtcgcgtactcgtagtacggacggccgtactccacctatcctacgagaacgaacgaaccgaccgaaagccgtcctaccgtagtacgtcgtagaacctaaagtcgaaacgtcgtacgtacgaacggtaccgtaggaaccggtaccgtaacccggttaccctttacgtttacgtttacgtacggtaacggttaaacccggttaaaccgggttccccggttaaggtccggtaacgtaacggtacgttacgtttaacgggttcggttttaaccgg

SEQ ID NO: 339074 - DNA, 636 bp, Homo sapiens
  misc_feature: GZ8MTXP01ATP5J.38.53.E09.1.454.CMB.2.raw
  modified_base (221)..(221): a, c, t, g, unknown or other
  misc_feature (221)..(221): n is a, c, g, or t
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (603)..(603): a, c, t, g, unknown or other
  misc_feature (603)..(603): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggcttaattttaaaaggtgtccagtgtagaagtgcagcgtggtggagtcgtggggganacgttggtagagccgtggcacggtcccctaggacgacttctccgtgtcgcacgccttcgtaggtattactaaattangaattaatcgacctatcgactacgtcgggtaccaanaacgctaccggaaggggaacgggccgtagggacggtcgggtactacgtaaggttgttaggtaacggaactaggtacgtaccagtaacgctaagtcggacgtactgtaggacggaacggacctagtccacactccacgagaacgaccgaacgaccgaacgctccctacctagtaccttcgaaggaaccaaagttacgaactcgtcgtaacgcgtacgagaccgtacgaaccgttcttatcttcgtacgacgaaccgacggacccggtaanacgaacgtagtacgttacgttaacggttcgttg

SEQ ID NO: 339075 - DNA, 607 bp, Homo sapiens
  misc_feature: GZ8MTXP01BC2E5.38.53.E09.1.454.CMB.2.raw
  modified_base (289)..(289): a, c, t, g, unknown or other
  misc_feature (289)..(289): n is a, c, g, or t
  modified_base (482)..(482): a, c, t, g, unknown or other
  misc_feature (482)..(482): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggatacgttggtagacgccgtggcgacggtccctgagactctcctgtgcacgtcctctggattactaaattangaataatgaccatcgactacgtcggtaccgacgaagccgtaccggaaggggacgggtcgtgggaaggttcgggtacctagtacggttaggttagtacggaagtaggtcgtaactagtacgtactgtcggcgtactggtagtagggacgcgtactacgactcgtacacgaagaacaccgaacacgaacgtaccnccttcgtaattctacagtaactaaagacgactagtgacgacgtcgaacgacggtccncgttcttnttacgttgtacgaacgaacggttaccgcgtaatcgcgtagtacgttagtaagttcgttcg

SEQ ID NO: 339076 - DNA, 599 bp, Homo sapiens
  misc_feature: GZ8MTXP01BYICO.38.53.E09.1.454.CMB.2.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
  modified_base (577)..(577): a, c, t, g, unknown or other
  misc_feature (577)..(577): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttggtagagcctggcaggtccctgagactctcctgtgcagcctntggattcaaattangataatcgaccatgctacgtgggtcccaanaacgctaccgaagggggacggcctgggagtgggtactacgaaggttgttacgttacgggaactaggtcggtaaccataacggccctaagtcggcgggtacttcgtggtaggaaacgggtccgtacttacaccgatcctaccgagacgaaccgaacgaccaaagacgcctacccgtagtacgtactgacaaagtacgaacgtaagtctagacgacccgtggacgacncggtccttntacttcgtagtcgacgaacggccccgtaagtccggnagtagacgtaaggttcgtttcg

SEQ ID NO: 339077 - DNA, 688 bp, Homo sapiens
  misc_feature: GZ8MTXP01DL2IH.38.53.E09.1.454.CMB.2.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtgggtggagtcgtggggganacgttggtagagcctggcaggtccctgagactctcctgtgcagcctgtggattactaaattangaataatgaccatgcacgtcgggtaccaacgaacgccgtacggaagggggaacggtccgtgggtaagtcggggtactacgtaaaggtttcgttaaggttacggaaactagggtacgtaaccaagtaacgacttaagtcggacggtactcgtaggtacgggaacggggtccgtattaccgaacctactaccgtaccgaaaggaacgaaaccaaccgaccgaaacgacgtccttaccgtagttacttactacggaacctaaagtacgaaacgtagtaccgtaggacgtacgtacggacggacctaaccggttccttacgttactttcgtacggtacgaaccgttaaaaccgggccccgttaagtacggtaaccgtagtacgttacgttaacgttcggttttaacg

SEQ ID NO: 339078 - DNA, 786 bp, Homo sapiens
  misc_feature: GZ8MTXP01BDTWG.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagtacgttggtagagccgtggcaggtccctgagactctcctgtgcagcctctggtattactaaattaatgaattaagtcgaccctaagtcgacctaacggttcggggtaccccgaaacgaaacggtcccgttacccgggaaaggggggaaacggggtccccgttagggggtaagggttcgggggttaccttaacggtaaagggtttggttttaaggttaccgggaaaccgtagggttacggtaaccctaagttaaccggacccttaaggtcgggaccggtacgttccgtagggttacgggaaacggggtcccgtacgtttacccaaccgtacttccgtacccgaggaaccgaaccgaaaccgacccgaaagtacgtaccttcccgtagtacgtacgttacgaactaaagtacgtaacgtagtacgtaggacgtaccgtaggaaccggtaccgtaaccgggttcctttacgtttactttcgtcggtaaccggaacggttaaaaccgggttccccggttaaggtcgggtaacgtaacggtacgttaccgttaagggtttcggttttaaccg

SEQ ID NO: 339079 - DNA, 628 bp, Homo sapiens
  misc_feature: GZ8MTXP01B2FYB.38.53.E09.1.454.CMB.2.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
tcagtcgatcacgtcacgaccggtgctcgatttagagagagtgtgttgggtttggggggaagaggaagactgacggtcctgccacaggtggtgctgggcacggtgggcactcgacacaacatttgcgctcaactgtcttgtctcaccatggagttgggactgagctggtattttcctttggcttattttaaaaggtgtccagtgtgaagtgcagctggtggagtcgtggggganacttggtagagcctggcaggtcctgagactctcctgtgcagcctctggtattactaaatttangaataatgccatgcacgtggccanagctacgagggacgctggagtcggtctgagtgtagtagaacnggtcgtaccagtacgcctagtcgcgtactgtgtaggacgggccgtattaccacgtactcaccgaagaacgaccgaaacgaccgaaaggtacgtcccttacccgttaggtactcgtacggtaacctaaagtacgaaccgtagttctaacgggaacgttaccggttacgggaacggtaacccggtaaccggtttccctttacgtttacgtttcgtacggtaaccgtaaaccggaaaccgggttccccggttaaggttcggtaaccgg

SEQ ID NO: 339080 - DNA, 609 bp, Homo sapiens
  misc_feature: GZ8MTXP01BZGI5.38.53.E09.1.454.CMB.2.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtggggganacttggtagagcctggcaggtccctgagactctcctgtgcagcctctggattacaaattangataatgccatgcacgtgggtaccgacaagctaccgaagggggaacggccgtgggaggtcgggtcttcgaaaggttggttagttacggaactaggtcggtacccagtaacgcctaagtcggacgggtactcgtggtaggaacgggccgtattcacctatcctaccaagacgacaacgaccaagacgcctacctgtactcttagacaaatcgaacagtctagacgaccgtagacggacgaaccggtccttacttactttcgtacgtacgttaccgaaaacggttccccggtaagtcggaacgtaggtacgttacgtaagttaacggtttcg

SEQ ID NO: 339081 - DNA, 655 bp, Homo sapiens
  misc_feature: GZ8MTXP01BS74H.38.53.E09.1.454.CMB.2.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccgagggaaggcctggagtgggtctcaagtgttagtggaacagtggtacatagcctatgcgactctgtgaaggccattcacatcncagagacacgcaagngctccctgtatctgacaaatgaacagtctagacgacctggacggactaacggtcctttacttacttttctaggtacgaccgaaaaacggggtcccccggttatccggactaggtacgacgttaaggtaaacggtttctttcggaccttccggtcggggaccgtacggggtaaccccgggtctaacccgtcctaccctcgacgcccgtcccaaccgaaaccgggccctacgttcccggtcccttcccccgtcggccgtcccctacggggacccttcccggaacggaccgacccaccccgttaccgagaaccgccaccgtacggcccgtccggtcggcgttcgaccgttcggtaaccgacgttaccgttccttacgaaccgtagctcgacgttggaacgcggccg

SEQ ID NO: 339082 - DNA, 672 bp, Homo sapiens
  misc_feature: GZ8MTXP01DZFF6.38.53.E09.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (328)..(328): a, c, t, g, unknown or other
  misc_feature (328)..(328): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcggtggggganacgttgggtagagtccgtggcaggtcccctgacgtactctcctgtcgcagcctcgtggtattactaaattangtaataatcgcctatcgacacgtcgggtaccaanaacgcctaccggaagggggaacgggtcctagggagttcgggtactacgtaaaggttggtttacggttacggaactaggtacggtaaccagttaacgccttaagtcgacgggtactcgtggtagagtcgacgtattacacatcctacaagacacaacgacaaagcacctccgtaggtactctacgaacaaagtacgaactagttacacgaacgtaccgtcggaacggtaaccgtaccggttacctttctttacgtttacgtacggttacggttaacccgttaaaaccggggtccccgttaaaggtcggacgtaggttaccgttaacgttaaagggtttaaccggg

SEQ ID NO: 339083 - DNA, 688 bp, Homo sapiens
  misc_feature: GZ8MTXP01C9YWI.38.53.E09.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (488)..(488): a, c, t, g, unknown or other
  misc_feature (488)..(488): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagacgttggtagagccgtggcacggtccctgagactctcctgtgcagcctntgtattacaaattangatatcgcatgactagtcgggtaccaacaagccgtaccggaagggggaacgggtccgtaggggagtgggtctacgtaaggttgttacggttaggaacgtaggtaggtacctagtaacgaccttaaggtcgacgggtactcgtaggtacggaacgggccgtattcgacctatcctaccaaggaacgaaccaacggaaccaaggaacncccttaccccgtaggttactaccgtacgtaaactaaaacgtcggaaacctacgggtctaaacggaaccgttaacccggtagggaaacccggtacgtaaacccggttcctttacggttaactttccgtaagtacgaaaccggaaaccgggttcccgaagttacggctaaggtccgttagttaaagggttcccgttttaagg

SEQ ID NO: 339084 - DNA, 751 bp, Homo sapiens
  misc_feature: GZ8MTXP01EZDSR.38.53.E09.1.454.CMB.2.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctgggtggagtcgtggggggatacgttggtagacgccgtggcacggtccctganctctctgtcgcagcctctgtattacaaattangataatcgaccatcgcacgtcgggtaccgaacacgccgtaccgaagggggaacgggtccgtgggaggttcgggtcttacgaaggttacggtttagtaccggaacgtaggtacggtaacccagtaaccgaccttaagtcggtaccgggtacttcggtagggtacgggaaacgggtcccgtattacccaacctacgttcctaccgaaggaaccgaaaccaaaccggacccgaaaggccgtaccccttaccccgttagttaactaccgttaaggaaaccctaaaagtacgtaaaacgcgttacgtagggaaacccgtaccgtagggaacccggtaacgtaaccgggttccctttacgttaacgttttcgacggttaacggaaacccggttaaaaccggggttccccggttaagtcgggttaaccgaaggggttacgttacggttaaaacgggtttcggtttaacccg

SEQ ID NO: 339085 - DNA, 577 bp, Homo sapiens
  misc_feature: GZ8MTXP02J181Z.38.53.E09.1.454.CMB.2.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagtcgatcacgtcacgaccggtgctcgatttagagagagtgtgttgggtctggggagacttggtagagcctggcaggtccctgagactctcctgtgcagcctctggattcaaatttaatgataatgccatgcactgggtccgacaagctccagggaagggcctggagtgggtctcaagtgttagttggancagtgtaccatagcctatgcggactctgtgaagggccattcaccatcnccagagacaacgccaagagctccctgtatctgcaaatgaacagtctgagacctgaggacacggccttctatttcngtgacaaacggcccgtatggcagtagctaagagttcttgactcgtggggccaggggacccggtcaccgtctcctcacgccctccaccgaacgggccccagtccggtccttcccccgtggccgccctgcctccgagggacgccacccgtccgagacgccacacgccggtccccgtggggcctcggcccttaggggtccaaacggggtacccttaaccgttcccgaaccggttgaacttccggaaccttggacggtcccggggg

SEQ ID NO: 339086 - DNA, 555 bp, Homo sapiens
  misc_feature: GZ8MTXP02JDZN2.38.53.E09.1.454.CMB.2.raw
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
tcagtcgatcacgtcacgaccggtgctcgatttagagagagtgtgttgggtttggggagaggagcccagccctgagattcccaggtgtttccattcagtgatcagcactgaacacagaggactcaccatggagttgggactgagcgtgagtttcctttaggctatttaaaggtgtccagtgtgaagtgcagctggtggagtctgggggagacttggtagagcctggcaggtccctgagactctcctgtgcagctctggattcaattaattanatatncatgcacgtggtcgacagcncgaggaggcgtggaggtggtcgtcgtagtagttagttaggtacgagtagtacgtatagactntgcgacgtcgtgtgaggacgactcacactctcagagacaacgacgaacgacgctacctcgtactactacgtacaatagaacgacgtacgtagtacgacgtacgacgacgacggtaccgttacttactttacgttacgtacgtacgtaaacggaccggtaacgtacggtacgacgtacgtacgtaacgtacgttacg

SEQ ID NO: 339087 - DNA, 539 bp, Homo sapiens
  misc_feature: GZ8MTXP02IW4RH.38.53.E09.1.454.CMB.2.raw
  modified_base (213)..(213): a, c, t, g, unknown or other
  misc_feature (213)..(213): n is a, c, g, or t
  modified_base (298)..(298): a, c, t, g, unknown or other
  misc_feature (298)..(298): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagcgtggagtttcctttaggctatttaaaaggtgtcagtgtgaagtgcagctggtggagtctggggganacttggtagagcctggcaggtccctgagctctcctgtgcagcctctggattcaaatttaatgataatgccatgcattgggccganaagctccgagggaaggcctgggagtgggtctcgaagtgtagttggaacagtggtaccatacgcctatcgcggactctgtgaaaggggcccaattcaccatctccaagagaccaaacgccaaaggntctcctcgttactctcacaanagacagtactgacgacgagacgacgacgtcttcttacttctcgtacgacgaacggtaccggtaacgtcgacgtacgtagtacgtacgtacgttcg

SEQ ID NO: 339088 - DNA, 526 bp, Homo sapiens
  misc_feature: GZ8MTXP02JLIIO.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgcaaaaggccccggtatcggcagtagctaagagttcttgactctggggccaggggaacccgggtcaccgtctccctcagccctccaccaaggcccatcggtcctccccgtgccgccctgctccaggacgcacctccgagacgcacagcggccctgggctgcctgggtcaacggcctacttccaacgtcgactccgatggacgcgggc

SEQ ID NO: 339089 - DNA, 612 bp, Homo sapiens
  misc_feature: GZ8MTXP02H02QM.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaaggccattcaccatctccagagacaacgcaagagctccctgtatctgacaaatgaacagtctgagacctgaggacacggccttctatttctgtgactaaaacggccccgtatcggacagtagctaagaggtttcttgactcgtggggccaggggacccggtcaccgtctcctcagcctcccacgaaacgggccccaagtccggtcccttcccccgtcggcccgtcccctaggcccttcccgacggacgccaacccgcccgagacgcaaccgacggccggtccccgtgggggccttcggccccgttagggtaccaaacggggtacccttaaaccgtttcccgaaaccggttgaaacgttccgaaaccgttcggaacggccggggtccg

SEQ ID NO: 339090 - DNA, 516 bp, Homo sapiens
  misc_feature: GZ8MTXP02GIJCA.38.53.E09.1.454.CMB.2.raw
  modified_base (275)..(275): a, c, t, g, unknown or other
  misc_feature (275)..(275): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagacttggtagagcctggcaggtccctgagactctcctgtgcagcctctggattcaaatttangataatgccatgcactgggtccacaagctccaggggaaggcctgggagtgggtctcgaagtgttagtggaacagtggtaccatagcctatgcggactctgtgaagggccattcaccatctccagagacaacgccaagacgctccctgtatctgacaaatgaaacagtctgagacctgagacacggccttntacttcngtcgacaaacggcccgtaatcggacagtagctaagtacggtttc

SEQ ID NO: 339091 - DNA, 580 bp, Homo sapiens
  misc_feature: GZ8MTXP02FNQ1G.38.53.E09.1.454.CMB.2.raw
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgacaaaacggccccggtatggcagtagctaagagtttcttgactcgtggggccaggggacccgggtcaccgtctcctcacgccctccaccgaacgggcccagtccggtcctccccgtggccgccccttggcctcccgagggacgcccaccgtccgagacggcacgacgccggccccgtggggcctcggccgttcgggtaccaaacgggaccttaccgtttcccgaacggttcgaacgtccggaacgtcggacggtccgggg

SEQ ID NO: 339092 - DNA, 555 bp, Homo sapiens
  misc_feature: GZ8MTXP02FWLSK.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgcaaaaggccccggtatcggcagtagctaagaggttctttgactctggggccaggggaacccgggtcaccgtctcctcacgcctcccaccaacggggccccatccggtccttcccccgtggccgcccctgcctcccgacgggacgccaccctccgagagcacacgccggccctcggggcctgcccgtgggtacaacgggacctacgttccaacgttgactcgactgacggcggtcg

SEQ ID NO: 339093 - DNA, 558 bp, Homo sapiens
  misc_feature: GZ8MTXP02GV9XY.38.53.E09.1.454.CMB.2.raw
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgcaaaacggcccggtatggcagtagctaagaggttctttgactccgtggggccaggggaacccgggtcaccgtctcccgtcacgccctcccaccgaacgggccccaagtccgggttccttccccccgtgggcccgccccttggccctccgagggacgccaccgtcccgagacgccacgacgccggcctgggctcgccgtcggtcaacggactactccgacgtcgactcgactgacgcgg

SEQ ID NO: 339094 - DNA, 531 bp, Homo sapiens
  misc_feature: GZ8MTXP02JWU3Q.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgcaaaaggccccggtatcggcagtagctaagaggttcttgactctggggccaggggaacccgggtcaccgtctcctcacgcctccaccaacggggccccagtccggtccttcccccgtggccgcccctggcctccaggacgccacctccgagacgcacagcgccctgggctgcctggtcaggctactccaacgtgactcgactgacgcggcg

SEQ ID NO: 339095 - DNA, 564 bp, Homo sapiens
  misc_feature: GZ8MTXP02JIL5N.38.53.E09.1.454.CMB.2.raw
  modified_base (249)..(249): a, c, t, g, unknown or other
  misc_feature (249)..(249): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccaganacaacgccaagagctccctgtatctgcaaatgaacagtctgagacctgagacacggccttctatttctgtgcaaaaggccccggtatcggcagtagctaagaggttcttgactcgtggggccaggggaacccggtcaccgtctcctcacgcctccaccgaacggccccatccggtccttccccctggcccgccctgcctcccgaggacgccaccgtccgagacgcacagccgcccgtgggcctcggcccgtacggtcgaacggtacctaccgttacccgaacggttcgaactccggtaacctggacggcgggccg

SEQ ID NO: 339096 - DNA, 550 bp, Homo sapiens
  misc_feature: GZ8MTXP02GLE0P.38.53.E09.1.454.CMB.2.raw
  modified_base (438)..(438): a, c, t, g, unknown or other
  misc_feature (438)..(438): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaagggccgattcaccatctccagagacaacgccaagagctcccctgtatctgcaaatgaacagtctgagacctgaggacacggccttctatttctgtgcaaaaggccccgtatgcagtagctaagagttcttgactccgtggggccagggacccgggtcaccgtctcctcacgcctccaccaacgggcccaattccggtaccttccccctggccnccctcgctcccaggacgccacctccgagacgccacagtccggcctcgggctcgccctggtacgaacggacttacgttcccgacgttcgaactccgaacgtcgacggccgggg

SEQ ID NO: 339097 - DNA, 564 bp, Homo sapiens
  misc_feature: GZ8MTXP02HR524.38.53.E09.1.454.CMB.2.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtggggganacttggtagagcctggcaggtccctgagactctcctgtgcagcctctggattcaaatttangataatcgccatgcacgtgggtccgacaagctaccgaggggaaggcctgggagtgggtctcgaagtgttagtggaacagtggtaccatacgccttagtgcggactcgtgtgaaagggccgattccacatcctaccagagaccaaacgaccaaagacgctccccgtagttactcttagacaaaatcggaaaccagttccagacgacctgaacggacacggtcctttctattcgtagtcgactaaaacggccccgtaagtcggaccagtacgacgtaaaggtaggtttccg

SEQ ID NO: 339098 - DNA, 551 bp, Homo sapiens
  misc_feature: GZ8MTXP02FZWFK.38.53.E09.1.454.CMB.2.raw
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagccctctggattcaaattatgataatgccatgcactgggtccgacaaagctccgaggggaagggcctgggagtgggtctcaagtgttagtggaacngtaggtaccatagcctangcggactctgtagaaagggccgatcaccatctcagacgaccaacgaccaagacgctcccctgtactctgacctaaaatagaaaccgagtctagaacgacctaggacggaacaacggtccttactactttctagtacgacgaaaacggccctaaggtagtcggacagtacgataacgtagg

SEQ ID NO: 339099 - DNA, 553 bp, Homo sapiens
  misc_feature: GZ8MTXP02FZTZ1.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgacaaaaggccccggtatcggcagtagctaagaggttcttgactcgtggggccagggaaccggtcaccgtctcctcacgcctccacgaacgggcccaagtccggtccttccccctggcccgcccctgccctccgagggacgccaacccgtccgagacgcacgacgccggccctgggctcgccgtggtacaacggacctacttccgaacgtcgaacgtccgactgacggcggacg

SEQ ID NO: 339100 - DNA, 722 bp, Homo sapiens
  misc_feature: GZ8MTXP02IOPA9.38.53.E09.1.454.CMB.2.raw
  modified_base (216)..(216): a, c, t, g, unknown or other
  misc_feature (216)..(216): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttggtagagcctggcaggtccctgagactctctgtgcagcctctggattcaaatttaatgataatgccatgcacgtgggtccgacaagcctaccgaggggaacgggcctagggagttcggggtctacgaaggttggtttaggtttacggaaactaggtacgggtaaccagtacggacctagtcggccggtaacttccgtagggttagggaaacgggggtcccgtagtttaccaaccctaatcccgtacccgaagaaacgaacccgaaaaccggacccaaaaggacggtcccttacccccgttaggttaacttaccttacggaacctaaaagttacgaaacccgtaggttaccgttaggaaacggtacccgttaagggaacgggtaacccgtaaccgggttcccttttacttaaacgtttttccgtagttacgaaaccgtaaaaccgggtcccccggttaagtcgggactaggtaacgaccgtttaaacggtacggtttttaccg

SEQ ID NO: 339101 - DNA, 571 bp, Homo sapiens
  misc_feature: GZ8MTXP02I4QAP.38.53.E09.1.454.CMB.2.raw
  modified_base (350)..(350): a, c, t, g, unknown or other
  misc_feature (350)..(350): n is a, c, g, or t
  modified_base (437)..(437): a, c, t, g, unknown or other
  misc_feature (437)..(437): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaaggcctggagtgggtctcaagttgttagttggaacagtggtaccatagcctatgcggactctgtgaagggccattcaccatctccagagacaacgccaagagctccctgtatctgcaaatgaacagtctgagacctgaggacacggccttctatttctgtgacaaaaggccccggtatgcagtagctaagngttcttgactccgtggggccaggggacccggtcaccgtctccctcacgccctccaccacgggcccagtccgtccttcccctggcccnccctcgcctcccagggacgcccaccgtccggacgaacgccacgacggtcccggcccgtggggcctcggccgtcgggtaccaaacgggtacctaccgttccgaacggtcgaacgttcggacctggacggccgggg

SEQ ID NO: 339102 - DNA, 530 bp, Homo sapiens
  misc_feature: GZ8MTXP02JWOT2.38.53.E09.1.454.CMB.2.raw
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (482)..(482): a, c, t, g, unknown or other
  misc_feature (482)..(482): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaatttaatgataatgccatgcacgtgggtccgacaagctccgaggggaaggcctgggagtgggtctcgaagtgttagtggaacagtggtaccatagcctatgcggactcngtgaagggccgattcaccatcnccagacacaacncaagcgctaccngtactctgacaatgaacagtctgacgacctgacggtacagtcggccttctatttcngtcgacgaaaacggcccgtagtcgggacaggtacgacgtaaggtacgg

SEQ ID NO: 339103 - DNA, 620 bp, Homo sapiens
  misc_feature: GZ8MTXP02JU5Y7.38.53.E09.1.454.CMB.2.raw
  modified_base (279)..(279): a, c, t, g, unknown or other
  misc_feature (279)..(279): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattacaaatttaangaataatgccatgcacgtgggtccgacaagctaccgaggggaacggcctgggagtgggtctacgaaggtgttaggttacggaacgtaggtcggtaaccagtacgccttagtcggacggtactcgtggtaggaaacgggccgtattccaccgtatccgccagacgacaaccgacgaaagacgcctaccctagtactctagacaaagtgaaacagtctaggacgaccgtaggaacggactaaccggtcctttacttacttttccgtaggttacgaaccgtaaaaccggggtccccggtaagttacgggactaacggtacgtaccgttaaaggtacgttttccg

SEQ ID NO: 339104 - DNA, 518 bp, Homo sapiens
  misc_feature: GZ8MTXP02FZTSY.38.53.E09.1.454.CMB.2.raw
  modified_base (501)..(501): a, c, t, g, unknown or other
  misc_feature (501)..(501): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgacaaaaggccccggtatcggcagtagctaagagttcttgactcgtggggccaggggaacccggtcaccgtctcctcacgcctccaccaaggcccatcggtcctcccctgccgccctgcctcaggacgcaccctcgagacgcacagccgccctgggcctgcctggtcaacgctactcaacgtnactcgactgacgcggcg

SEQ ID NO: 339105 - DNA, 616 bp, Homo sapiens
  misc_feature: GZ8MTXP02F4X85.38.53.E09.1.454.CMB.2.raw
  modified_base (504)..(504): a, c, t, g, unknown or other
  misc_feature (504)..(504): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggattcaaatttaatgataatgccatcgcacgtgggtccgacaagcctaccgaaggggaacggccgtgggaggtggggtctacgaaggttggtttaggtacggaaactagtacggtaaccagtacgccttagtcggacggtactcgtggtaggaaacggggccctattccgaacctatcctaccaagacgaccaacgaccaaagacgcctacccctgtaactcgtgactaaatgaaaccngtcagacaccgtgaacggacacggtcctttactactttcgagttacgaaccgtaaaaccgggtccccggtaagtcggacgtaaggtacgtaccgtaaaggttcggtttaccg

SEQ ID NO: 339106 - DNA, 586 bp, Homo sapiens
  misc_feature: GZ8MTXP02IJF43.38.53.E09.1.454.CMB.2.raw
  modified_base (219)..(219): a, c, t, g, unknown or other
  misc_feature (219)..(219): n is a, c, g, or t
  modified_base (476)..(476): a, c, t, g, unknown or other
  misc_feature (476)..(476): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctgggtggagtcgtggggganacttggtagagcctggcaggtccctgagctctcctgtgcagcctctggattactaaatttaatgataatgccatgcacgtgggtccgacaagcctaccgaggggaacgggcctgggaggtgggtctacgaaggtgttaggttcggaactgtggtaccatacgcctagtgcggtactctggtaggaaacggggtccgtacttcacctactccgtaccagacgaccaaccgacaagacgctcctgtatctgacaagtanaacgagtactgacgacgtgagaccgacggtccttcttactttcgtagtcgaacgtaaaccggtacccggtaagtcggaacgtaggtaacgtacgttaaggtacggtttcg

SEQ ID NO: 339107 - DNA, 579 bp, Homo sapiens
  misc_feature: GZ8MTXP02HX78Z.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaattttaatgataatgccatgcactgggtccgacaagctccagggaaggcctggagtgggtctcaagtgttagttggaacagtgtaccatagcctatgcggactctgtgaagggccattcaccatctccagagacaacgccaaagagctccctgtatctgacaaatgaacagtctgagacctgaggacacggccttctatttctgtgacaaaaggccccgtatcggacagtgactaagaggttctttgacttccgtcggggtccgaacggggtaacccgggtcacccgtcctccctcacgccctaccaacccgaacggggcccacgtaccggtcccttcccccgtcggcccgtccctcggcctccgaggacgccaccgtccgagacgcacgacgccgcccgtcgggctcgccgtggacgaacggacctacgttccgaaccgtgactcgacgtcggacggcgggcg

SEQ ID NO: 339108 - DNA, 638 bp, Homo sapiens
  misc_feature: GZ8MTXP02JV19Y.38.53.E09.1.454.CMB.2.raw
  modified_base (216)..(216): a, c, t, g, unknown or other
  misc_feature (216)..(216): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacgttggtagagcctggcaggtccctgagactctcctgtgcagcctctggattcaaatttatgataatgccatgcacgtgggtccacaagctaccgagggaaggcctgggagtgggtctacgaaggtgttagtaggaacagtggtaccagtacgacctagtcgcggtacttcgtggtaggaaacgggcccgtagtttccaaccctactcctaccgaacgaacgaaccaaaccgacccaaaacggacgaccttaccccgtgttaactcgttagaactaaagtacgaaacgtaagtactaggaacgtacccgtaggacgggaacctaccgggttacctttacttaactttccgttaggttcgaaccgtaaaacgggccccggtaagtcggacgtaggtacgtaccgtaaaggtacggttttacg

SEQ ID NO: 339109 - DNA, 559 bp, Homo sapiens
  misc_feature: GZ8MTXP02HQOXL.38.53.E09.1.454.CMB.2.raw
  modified_base (219)..(219): a, c, t, g, unknown or other
  misc_feature (219)..(219): n is a, c, g, or t
tcagtcgatcacgtcacgaccggtgctcgatttagagagagtgtgttgggtctggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactcngtgaagggccgattcaccatctccagagacaacgccaagagctccctgtatctgcaaatgaacagtctgagacctgaggacacggccttctatttctgtgcaaaaggccccggtatcggcagtagactaagaggttctttggacttccgtgggggcccaagggggaaccccggtcacccgtcgtcctcgacgcctccaacccgaaacggggccccaagtccggtccttcccccgtggcccgtcccctgccttccgacggacgccacctccgagacgcacacgcgccctggggctgcctgggtcacggactacttccaacgtgaactcgactgacgcggcg

SEQ ID NO: 339110 - DNA, 564 bp, Homo sapiens
  misc_feature: GZ8MTXP02GSWZG.38.53.E09.1.454.CMB.2.raw
  modified_base (446)..(446): a, c, t, g, unknown or other
  misc_feature (446)..(446): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccgagggaagggcctggagtgggtctcaagtgttagttggaacagtggtaccatagcctatgcggactctgtgaagggccattcaccatctccagagacaacgccaagagctccctgtatctgacaaatgaacagtctgagacctgaggacacggccttctatttctgtgacaaaacggcccgtagtgcagtagactaagagtttcttgactccgtcggggccgacggggaacccggtcacccgtctcccgtcacgccctcccacgacgggcccacgtccggtcccttccccgnggccgccctcgcctccgaggacgccacctcgagacgcacgacgccgcccgtggcctcgccgtcggtacgaacggtaccttaccgtaaccgacgtacgactcgactcggacggccgggg

SEQ ID NO: 339111 - DNA, 687 bp, Homo sapiens
  misc_feature: GZ8MTXP02H2Y0U.38.53.E09.1.454.CMB.2.raw
  modified_base (288)..(288): a, c, t, g, unknown or other
  misc_feature (288)..(288): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggcttaattttaaaaggtgtccagtgtgaagtgcagctgggtggagtcgtgggggagacgttgggtagagcctgggcaggtccctgagactctcctgtgcacgcctcgtggattacaaaatttaangtaataatcgaccaatgacctacgtcgggtacccgaacgaacgcctaccggaaggggaacgggtcccgtggggtacggtcggggtctacgtaaaggttggttaagttacgggaaacgtaggtacggtaacctagtacggaccttagtcgggacgtaccttcgtaggtaggggaaacggccgtattccaaccgtactacctacccgaaggaacgaaaccgaaccgacccaaaggtacgacctaccccgttagttactacgtacgaacgtaaaatcggaaactacgtcgtaggaacgtaacccgtaggaacggaacctacggtcctttacttactttcgagtacgaacgtaaaacggcccggtaagaccggtacgaggtactacgtaacggtacgtttacg

SEQ ID NO: 339112 - DNA, 638 bp, Homo sapiens
  misc_feature: GZ8MTXP02HFAUH.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaattttaatgataatgccatgcactgggtccgacaagctccagggaagggcctggagtgggtctcaagtgttagttggaacagtggtaccatagcctatgcggactctgtgaagggccattcacatctccagagacaacgccaagagctccctgtatctgcaaatgaacagtctgagacctgacggacacggccttctatttctgtgacgaaaacggccccggtatcggcagtagctaagtagttctttgacttcgtcggggccgacggggtaacccggtcacccgtcctcctccgacgccctccaacccgaacgggccccacgtcccggtcccttcccccgcgggcccgccccgttcgcccgttcccgacgggaccgaccaccccgtccggacgacgaccgaaccgacgggcccggccccgttcggggcccgtcggcccgtcgggttacccgaaacgggtacccgttacccgtttacccgaaccgttacggacgttaccggacgtcggacggggccgggtcgg

SEQ ID NO: 339113 - DNA, 532 bp, Homo sapiens
  misc_feature: GZ8MTXP02G6KAM.38.53.E09.1.454.CMB.2.raw
  modified_base (267)..(267): a, c, t, g, unknown or other
  misc_feature (267)..(267): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
tcagtcgatcacgtcacgaccggtgctcgatttagagagagtgtgttgagtctgggggagacttggtagagcctggtaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctcccngtatctgcaaaatgaacagtctgagacctgagacacggccttctatttctgtgacaaaaggccccggtatcggcagtagctaagaggttctttgactctggggccacggggaccgggtcaccgtctccctcacgcctccacccgaagggccccatccgggtccttccccctggccgccctgcctcaggacgccaccgtccgagacgcacagccggcccncggggcngcctgtcaagctactccaagtcactcgactgacgcggcg

SEQ ID NO: 339114 - DNA, 578 bp, Homo sapiens
  misc_feature: GZ8MTXP02HAQKV.38.53.E09.1.454.CMB.2.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
  modified_base (471)..(471): a, c, t, g, unknown or other
  misc_feature (471)..(471): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctcagagacaacgcaagagctccctgtatctgacaaatgaacagtctgagacctgaggacacggccttctatttctgtcgacgaaacggccccggtatcggcagtagctagngttcttgactcgngggcagggaccggcaccgtctctcacgcctccaccgacggccccagtccgtcccttccccnggcccgccctcgcctccgacggcgccacccgtcgacgcgccaacncggcccgcccgtcggggccgtcgcccgtcgggtaccgaacgggtacccttaccgttacccgaacggttcgaaccgtccggtaacgtcgggaacggcccggggtccgg

SEQ ID NO: 339115 - DNA, 706 bp, Homo sapiens
  misc_feature: GZ8MTXP02G5LLV.38.53.E09.1.454.CMB.2.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttgggtagagcctggcaggtccctgagactctcctgtgcagcctnggattcaaatttangataatgccatgcacgtgggtccacaagcctaccgaggggaacggcctgggagtgggtctacgtaagtgttagtacggaactagtcggtaccatacgctagtcggacggtactcgtgtaggaacgggccctaagttaccaaccctatccctaccgaagaacgaacccgaaaccgacccaaaacgaccgtacccttaccccgttaggtaaccttacgttacggaacctaaaaggttcgaaaaccgtacggttaccgtaggaaacggtaccccttaaggggaaaccggaacccgtaacccggggttccctttaacgtttacgttttaccgtacgggttacgaaacccggtaaaaaccgggggtcccccggttaagtacggggacctaaaggttaccggaacgtttaaaacgggttacgttttaccgg

SEQ ID NO: 339116 - DNA, 542 bp, Homo sapiens
  misc_feature: GZ8MTXP02H9V7Z.38.53.E09.1.454.CMB.2.raw
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
tcagtcgatcacgtcacgaccggtgctcgatttagagagagtgtgttgagtctgggggagacttggtagagcctggcaggtccctgagactctcctgtgcagcctctggattcaaattttaatgataatgccatgcactgggtccgacaagctccaaggggaagggcctggagtgggtctcaagtgttagtggaacagtggtaccatagcctatgcggatctgtgaagggccattcacatctccagagacaacgccaagagctccctgtatctgcaaaatgaacagtctgagacctgaggacacggcctttntatttcngtgacaaaaggcccgtangcagtagctaagngttcttgactcgtgggccagggaccgtcaccgtcnctcacgcctccacgaacggcccagtccgtccttcccccnggccnccctcgcctccagggacncaccctccggacgcgaccacgacgcccggcccgtcgggcctcgcccgtggtaccaacggacctaccgttccgacgtcgactgactgacggccggg

SEQ ID NO: 339117 - DNA, 566 bp, Homo sapiens
  misc_feature: GZ8MTXP02IINVC.38.53.E09.1.454.CMB.2.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (358)..(358): a, c, t, g, unknown or other
  misc_feature (358)..(358): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctgggtggagtcgtggggganacttggtagagcctggcaggtccctgagactctcctgtgcagcctctggattacaaatttaangataatgaccatgcacgtggtccgacaagctaccgaggggaacggcctgggagtgggtctcgaagtgttagtggaacngtgtaccatacgcctagtgcggactctgaggaagggccattcacatcaccagacgaccaacgccaaagacgctccctgtactctgacaaatagaaactgtctagaacgcctagacggaccaacggtcctttctactttcgacgttacgaaccgtaaaacgggtccccggtaagtcgggacgtaggtagtacgttaaaggtcggttttc

SEQ ID NO: 339118 - DNA, 614 bp, Homo sapiens
  misc_feature: GZ8MTXP02JE0DV.38.53.E09.1.454.CMB.2.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
  modified_base (274)..(275): a, c, t, g, unknown or other
  misc_feature (274)..(275): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttgggtagagcctggcaggtccctgagactctctgtgcngctctgattcaaattannataatgccatgcacgtggaccacaagctaccgaggggaacggcctgggagtgggtctagagtgttagtcggaanagtcgtaccagtacgcctgngcgtactcgtgtaggaacgggccgtattccacctagtacctacccgaagacaaccgaaccggaccaaaggacgcccgtaccccgttaggttaaactccgttacggaaaccctaaaagttacggaaaaccgtacggtaccgttaggaacgtacccgttagaacgggactacgtcggtaccttacgttattcgtgtacgaccgtaaaacggtcccgtaagtcgacgtagtacgtacgtaaggttcgg

SEQ ID NO: 339119 - DNA, 698 bp, Homo sapiens
  misc_feature: GZ8MTXP02IZU8W.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagacttggtagagcctggcaggtccctgacgactctcctgtgcagcctcgtggattacaaatttaatgaataatcgaccatgccacgtgggtccaacaacggtcctaccggaaggggaacgggcccgtaggggtacggttcggggtacctacgtaaaggtttggtttaaggttacgggaaaccgtaggttacggtaaccctagttaacggccttagtcggaccggtacttcgtaggtagggaacggggtccgtacgttaccaccctactcctaccgaagacgaaccaaaccgaccaaacgacgcccttacccgtagttaactcgtacgtacctaaagtacgaacgtacgttacgtaggaacgtacctaggacggaccgtacggtccctttacttacgtttcgtacggtacgaaaccggtaaaccgggtaccccggtaagtccggtacgtaacgtacgtaaccgttaacggtacggttttaccg

SEQ ID NO: 339120 - DNA, 550 bp, Homo sapiens
  misc_feature: GZ8MTXP02GYUG6.38.53.E09.1.454.CMB.2.raw
  modified_base (444)..(444): a, c, t, g, unknown or other
  misc_feature (444)..(444): n is a, c, g, or t
  modified_base (483)..(483): a, c, t, g, unknown or other
  misc_feature (483)..(483): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgacaaaaggccccggtatggcagtagctaagagttctttgactccgtggggaccacggggaacccggtcaccgtctccgtcacgccctccaaccaaacgggccccaagtccggtccttcccccgnggcccgccctgcctcccaggacgcaacccgtcgacgacncgaccagtccggcccctggggctcgcctggacacggactactcccgaagtcgatcgactgagcggcg

SEQ ID NO: 339121 - DNA, 661 bp, Homo sapiens
  misc_feature: GZ8MTXP02G87Y8.38.53.E09.1.454.CMB.2.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
  modified_base (499)..(499): a, c, t, g, unknown or other
  misc_feature (499)..(499): n is a, c, g, or t
  modified_base (521)..(521): a, c, t, g, unknown or other
  misc_feature (521)..(521): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtggggganacttggtagagcctggcaggtccctgagactctcctgtgcagcctctggattcaaattangataatgccatgacacgtcgggtaccgaacaagctacccggaaggggtaaacgggccgtggggaaggttcggggtacctacgtaaaggttgtttaggtacgggaaacctaggttacgggtaacccaagttacgcccgttagtcggacggtaacttcgtaggtacgggaaacgggcccgtagttccaacctacgtctaccaagaacgaccaacgaccaaaggacncctaccccgtagtactacgtanaacctaaagtacgaaacctaggtacctaggaacgaccgtaggaacgacgtacggtacccttagttacttcgtagttacgaaccgtaaaacgggccccgtaagtcggtaccgtaggtacgaccgtaaaggtcgttttaccg

SEQ ID NO: 339122 - DNA, 594 bp, Homo sapiens
  misc_feature: GZ8MTXP02I4597.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaaggcctattcaccatctccagagacaacgccaagagctccctgtatctgcaaatgaacagtctgagacctgaggacacggccttctatttctgtgacaaaaggccccgtatcggcagtagctaagaggttcttgactccgtggggccgacggggaacccggtcaccgtctcctcacgccctaccaaccgaacgggcccacgtccggtcccttcccccgcggcccgtccctcgccctccgacggcgacccacccgccgaagcgacaccgacggcccggcccgtgggccttcggcccgtcggtaccgaaacgggacccttaccgttaccgaacggttacgacgttaccggaaccgtggaccggcggtccgg

SEQ ID NO: 339123 - DNA, 582 bp, Homo sapiens
  misc_feature: GZ8MTXP02H5HRN.38.53.E09.1.454.CMB.2.raw
  modified_base (455)..(455): a, c, t, g, unknown or other
  misc_feature (455)..(455): n is a, c, g, or t
  modified_base (499)..(499): a, c, t, g, unknown or other
  misc_feature (499)..(499): n is a, c, g, or t
  modified_base (559)..(559): a, c, t, g, unknown or other
  misc_feature (559)..(559): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccaggggaagggcctggagtgggtctcaagtgttagttggaacagtggtaccatagcctatgcggactctgtgaagggccattcaccatctccagagacaacgccaagagctccctgtatctgacaaatgaacagtctgagacctgaggacacggtccttctatttctgtgacgaaaaggccccggtatcggcagtagctaagaggtttctttgacttccgtgggggcccacgggggaacccggtcacccgtcctcctcacgccctccacccgacgggccccaagtccggtcccttcccccgnggccgccccttgcctccgaggacgccacccgtccgagacgccanacgcccggcccgtgggccttggccctgggtaccaacgggaccttaccgtccgaaccgttnacgttccgactggacggcggtcg

SEQ ID NO: 339124 - DNA, 602 bp, Homo sapiens
  misc_feature: GZ8MTXP02GEJ6I.38.53.E09.1.454.CMB.2.raw
  modified_base (222)..(222): a, c, t, g, unknown or other
  misc_feature (222)..(222): n is a, c, g, or t
  modified_base (493)..(493): a, c, t, g, unknown or other
  misc_feature (493)..(493): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccgagggaagggcctggagtgggtctcaaggtgttagttggaacagtggtaccatagcctatgcggactntgtgaagggccattcaccatctccagagacaacgccaagagctccctgtatctgacaaatgaacagtctgagacctgaggacacggccttctatttctgtgacaaaacggcccgtatcggcagtagactaagtagttcttgactcgtcggggccaacggggtaacccgggtcacccgtctcccgtcacgcctacccaccgaacggcccacgtccggtccttcccccgtcggcccgccctcgcctccgacggacgccacccgtcgacggacnccaacgacgtccggcccgtcgggggcctcggcccgtcgggtaccgaaacgggtacccttaaccgtcccgtaaccggtagtaacgtcccggaacgtcggaacggccgggg

SEQ ID NO: 339125 - DNA, 559 bp, Homo sapiens
  misc_feature: GZ8MTXP02GLN94.38.53.E09.1.454.CMB.2.raw
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
  modified_base (425)..(425): a, c, t, g, unknown or other
  misc_feature (425)..(425): n is a, c, g, or t
  modified_base (453)..(453): a, c, t, g, unknown or other
  misc_feature (453)..(453): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttcctttggctaattttaaaaggtgtccagtgtgaagtgcagctggtggagtcgtggggganacttggtagagcctggcaggtccctgagactctcctgtgcagccctntggattcaaattaangataatgccatgcagtggccanaagctccgaagggaacggcctgggacgtgggtctgaagtgttagtgaaacngtgtaaccatagctatgcgactctgtgaaaggccaattcgaaccatcctccaaggacacaaacgcccgtaaaagngacctccctagtactcgtagactaaaanagaacacgtactagagacacgacgacgacggtaccgttaccttattcttagtacgtacgaaacggaccggtaacgtagacgacgtacgtacgtaacgtagtttacg

SEQ ID NO: 339126 - DNA, 684 bp, Homo sapiens
  misc_feature: GZ8MTXP02J3CP4.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggattacaaatttaatgataatgccatcgcacgtcgggtccaacgaacgcctaccggaaggggaacgggcctagggaggttggggtctacgtaaaggtcggttaggttcggaaactaggtacggtaccagtacgcctagtcgcggacttcgtagtggaaacgggcccgattcgaccactcctaccgagacgacaaccgaccaagacgcctccctagtactcgtgaaccaaagtacgaaactaggttacgtaggaacgtacccgtaggaaacccgggtaccgtaacccggggttaccctttaccgttaacgtttacccgtagggttaccgaaacccggtaaaaacccggggtcccccggggttaaagtcggggaccgtaaacggtaacggtacccgttaaaaggggttacgtttttaccgg

SEQ ID NO: 339127 - DNA, 542 bp, Homo sapiens
  misc_feature: GZ8MTXP02FTBFO.38.53.E09.1.454.CMB.2.raw
  modified_base (178)..(178): a, c, t, g, unknown or other
  misc_feature (178)..(178): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaagggcctggagtgggtctnaagtgttagttggaacagtggtaccatagcctatgcggactctgtgaagggccattcaccatctccagagacaacgccaagagctccctgtatctgacaaatgaaacagtctgagacctgaggacacggccttctattctgtgacaaaacggcccgtatggcagtagctaagagttcttgactcgtggggccgacggggaacccgggtcaccgtctccctcacgccctccaccgaacgggcccacgtccggtcccttcccccgtggcccgccctcggcctccgagggacgccacctccgagacgcacgagccgccgtggctcgcctggtacaacggctactcgacgtcactcgactcgagcggg

SEQ ID NO: 339128 - DNA, 568 bp, Homo sapiens
  misc_feature: GZ8MTXP02I426T.38.53.E09.1.454.CMB.2.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccaggggaagggcctggagtgggtctcaagtgttagtggaacagtggtaccatagcctatgcggactctgtgaagggccattcaccatctccagagacaacgccaagagctccctgtatctgacaaatgaacagtctgagacctgagacacggccttctatttctgtgacaaaacggccccggtatcggcagtagctaagagttcttgactcgtggggccaggggaaccggtcaccgtctcctcacgccctaccaccgaacgggccccagtccggtccttcccccgtggcccgaccctggcctccgaggacgcccaccgtccgagacgccacacggccggcccgtcgggccttcggcccgtggtaccgaacgggtacctaccgttaccgaacgttgactcgactggacggcgggcg

SEQ ID NO: 339129 - DNA, 537 bp, Homo sapiens
  misc_feature: GZ8MTXP02I2HT7.38.53.E09.1.454.CMB.2.raw
  modified_base (395)..(395): a, c, t, g, unknown or other
  misc_feature (395)..(395): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctccctgtatctgcaaatgaacagtctgagacctgaggacacggccttctatttctgtgcaaaaggcccgtagtggcagtagctaagagttctttgactccgtggggccaggggacccgggtcaccgtctccncagcctccacacggcccatcgtcctcccctggccgccctgcctcccgaggacgccgacctccgagacgcaacgcgcggccctgggctcggcctacggtcgaacggacctaccgttccgacgacttcgacgtgacggcggtcg

SEQ ID NO: 339130 - DNA, 706 bp, Homo sapiens
  misc_feature: GZ8MTXP02I4NNL.38.53.E09.1.454.CMB.2.raw
  modified_base (220)..(220): a, c, t, g, unknown or other
  misc_feature (220)..(220): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtggggganacgttggtagagcctggcaggtccctgagactctctgtgcagcctcgtggtattactaaatttatagaataatcgccatcgactacgtcgggtaccaacacgtcctacggaaggggaacggggtccgtaggggtaggtcgggtctacgtaaggttggtttaaggttacgggaaactaggtacggtaacctaagttaccgcttagtcgggacggtacttcgtgggtacgggaaacgggtcccgtaatccaacctatccgtacgaagacgaccaaacggtcaaaggcgtccttcccgtaggttactcgtacgaaactaaaagttacgaaaccgtagtaccgtacgggaaacgttacccgtagggaaaccggtaccgtaacccggtttcctttagtttaaccgtttcgtaaacggttcgaaaacccgtaaaccggggtcccgttaaggacggtactaagggtacgtaccgttaagggttacgttttccg

SEQ ID NO: 339131 - DNA, 567 bp, Homo sapiens
  misc_feature: GZ8MTXP02JDWA0.38.53.E09.1.454.CMB.2.raw
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
  modified_base (439)..(439): a, c, t, g, unknown or other
  misc_feature (439)..(439): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttcngtgcaaacggccccggtatcggcagtacgctaagnggtttcttgactccgtgggggccaggggaacccggtcacccgtctcctcacgcctccaccgagggccccagtccggtccttccccgnggccgccctgctccgaggcgcacccgtccgagacgcacacggccgccccgtggggcctcggcccgtggtaccaacgggtaccttaccgttccgaacggttcgaacgtccgtaccgtgacggcgggacg

SEQ ID NO: 339132 - DNA, 632 bp, Homo sapiens
  misc_feature: GZ8MTXP02JL2IE.38.53.E09.1.454.CMB.2.raw
  modified_base (447)..(447): a, c, t, g, unknown or other
  misc_feature (447)..(447): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagacttggtagagcctggcaggtccctgagactctcctgtgcagcctctggattcaaatttaatgataatgaccatgcacgtcgggtccgaacaagctaccgaggggaacgggcctagggaggtcgggtctacgtaagtgttaggttacggaactaggtggtaaccagtacgtcctagtcgacgggtactcgtggtacggaaacgggcccgtattcacccgtatcctaccaagganaacccgaaacgacccgaaagacgccttacccgtgttaactccgtagactaaagtgaaacaggttactacggacgaccgtagaggacccgtaacgggtccctttacttacgtttcgtcgtacggaccgaaaaccggtccccggtaagtcggacgtaaggtacgtaacgtaacggtacggttttccg

SEQ ID NO: 339133 - DNA, 747 bp, Homo sapiens
  misc_feature: GZ8MTXP02ICSFS.38.53.E09.1.454.CMB.2.raw
  modified_base (279)..(279): a, c, t, g, unknown or other
  misc_feature (279)..(279): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagacttggtagagccgtggcaggtccctgagactctcctgtgcagcctctggattacaaatttaangaataatgccatgcacgtgggtccgaacaagcctaccgaggggaacgggcctgggaggtgggtctacgaaggtggttagttcggaaactaggtagggtaacccaagttacgacccgttagttcgggaccggggtaacctttccgtgggttaacgggaaaacgggggtcccccggtaaagtttcccgaaaccctaacgttacctaccccgaaggaaacgaaacccaaaacccggaccccgaaaagggaaccgtccccttacccccgttaggttaaacttcccttaggaaccctaaaaagtccggaaaactaacggttactacggaaacgtaaccccgtagggaaacggaaccgtaacccgggttccccttttacttaacttttcgtcgttacgaacccgtaaaacggggtcccccggtaaagtacggacctaagggtaacgtaccgtaaaacgggtttacggtttcccg

SEQ ID NO: 339134 - DNA, 705 bp, Homo sapiens
  misc_feature: GZ8MTXP02FZNGX.38.53.E09.1.454.CMB.2.raw
  modified_base (217)..(217): a, c, t, g, unknown or other
  misc_feature (217)..(217): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggctattttaaaaggtgtccagtgtgaagtgcagctgggtggagtcgtggggganacttggtagagcctggcaggtccctgagactctcctgtgcagcctctggattacaaatttaatgaataatcgaccatgacacgtcgggtccgacaagcctaccggaaggggaacgggcccgtgggacggttggggtacctacgtaaaggttgtttaggttacggaaacgtaggttacggtaaccctagtaacgcccttagtcggacggtacttcgtgggtaggaaacgggcccgtaattcccgaacctacgttcctaccgaagacgaacccaacgacccaaaggacgtccctacccgtagttactcgtagaaacctaaaagttcgaaaaccgtagttcgtacgaacgtaccgaggtaaccggaacaccgggttacctttacgttaacgttttccgtaggttaccgaaaccggttaaaacccgggtcccccggttaagttaccgggacgttaaggtacggtaaccgttaaagggttacggttttaaccg

SEQ ID NO: 339135 - DNA, 506 bp, Homo sapiens
  misc_feature: GZ8MTXP02JFNSN.38.53.E09.1.454.CMB.2.raw
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctccctgtatctgcaaatgaacagtctgagacctgaggacacggccttctatttctgtgcaaaaggccccggtatcggcagtagctaagaggttctttgactccgtgggccaggggacccggtcaccgtctcctcagcctcacacggcccatcgtctccccngcncctgctcagncacctcgngngcacagcgcctggctgccnggtcacggactacttccaacgtgactcgactgacgcggcg

SEQ ID NO: 339136 - DNA, 535 bp, Homo sapiens
  misc_feature: GZ8MTXP02IL5FL.38.53.E09.1.454.CMB.2.raw
  modified_base (213)..(213): a, c, t, g, unknown or other
  misc_feature (213)..(213): n is a, c, g, or t
  modified_base (275)..(275): a, c, t, g, unknown or other
  misc_feature (275)..(275): n is a, c, g, or t
  modified_base (344)..(344): a, c, t, g, unknown or other
  misc_feature (344)..(344): n is a, c, g, or t
  modified_base (397)..(397): a, c, t, g, unknown or other
  misc_feature (397)..(397): n is a, c, g, or t
tcagtcgatcacgtcacgaccggtgctcgatttagagagagtgtgttgggtttgggggagaggagcccagccctgagattcccaggtgtttccattcagtgatcagcactgaacacagaggactcaccatggagttgggactgagctggattttccttttggctattttaaaggtgtccagtgtgaagtgcagctggtggagtcgtggggganacttggtagagcctggcaggtccctgagactctcctgtgcagcctctggattcaaatttaangataatgccatgcatggtccacagctccagggaaggcctgggagtgggtctcgaagtgttagtggaacngtggtaccatagcctagtgcggactctgtgaagggccatcaccatcgtcaganacaacgccaaagacgctccctagtactctgacaatgaacagtctgaacggcctaggagaccacggtccttactattttccagttcgaaacaaaacggtccccggtaatcgggctacgtagacgtaaagtacggttttc

SEQ ID NO: 339137 - DNA, 628 bp, Homo sapiens
  misc_feature: GZ8MTXP02GKN2V.38.53.E09.1.454.CMB.2.raw
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaatttangataatgccatgcacgtgggtccanaacgctaccgaggggaacggccgtagggaggtcgggtactacgaaggttggttaggttacggaacgtaggttaggtaaccagtacgcctagtcggcggacttcgtaggtaggaacgggcctattccgaacctatcctaccgaagacgaaccaaccgaccgaaaggacgtcctacccgtagtactcgtagactaaaagtcgaaactagtctagaacgtaccgtggaacggaccgtaccggtccctttagttaactttcgtagtaccgaaccgtaaaaccgggtccccggtaagtcggactaggtacgacttaaagggtcggtttacg

SEQ ID NO: 339138 - DNA, 638 bp, Homo sapiens
  misc_feature: GZ8MTXP02HA7QD.38.53.E09.1.454.CMB.2.raw
  modified_base (216)..(216): a, c, t, g, unknown or other
  misc_feature (216)..(216): n is a, c, g, or t
tcagtcgatcacgtcacgaccggtgctcgatttagagagagtgtgttgggttggggggagaggagccccagccctgagattcccaggtgtttccattcagtgatcagcactgaacacagaggactcacatggagttgggactgagctggtattttcctttggcttaattttaaaaggtgtccagtgtgaagtgcagctggtggagtcgtggggganacgttggtagagccgtggcaggtccctgagctctctgtgcagcctctggattactaaaatttaatgaataaatgacctaatgacacgtcgggtacccgaacgaaagcctacccggaaggggaaacgggccgtaggggaggtcggggttacctagtaaggttggtttaaggtagggaaacgtaggttacgggtaaccaagtacgacctagtgggacggtactcgtgtagggaacggccgtattccaactatccgtacagacgaccaaacgaccaagtacgcctaccctgtaactctacgactaaatacgaactagtactagaacggttacccagggacgaaccgtacggtacccctttattacttccgtagtacgaaccgaaacggtccccgaagtacgacgtagagacgtaagtgtttaccg

SEQ ID NO: 339139 - DNA, 565 bp, Homo sapiens
  misc_feature: GZ8MTXP02GI33U.38.53.E09.1.454.CMB.2.raw
  modified_base (278)..(278): a, c, t, g, unknown or other
  misc_feature (278)..(278): n is a, c, g, or t
  modified_base (353)..(353): a, c, t, g, unknown or other
  misc_feature (353)..(353): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggattcaaatttaangataatgccatgcactgggtccgaacaagctccgaggggaacgggcctggagtgggtctcaagtgttagtgaacngtggaccatagcctatgcggactcgtgtgaaagggcccattccacatctaccagacgacaacgccaaagcgactccctgatctgacaaatagaaacagtctgaacgtaccgtagacggaactaccggtcctttaccgtatttcctaggtcaaccgtaaaaacgggtcccccggtaagtacgggctaggttaagcctaaaggtacggtttacg

SEQ ID NO: 339140 - DNA, 625 bp, Homo sapiens
  misc_feature: GZ8MTXP02G3JE3.38.53.E09.1.454.CMB.2.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
tcagtcgatcacgtcacgaccggtgctcgatttagagagagtgtgttgggtttggggggagaggagccccagccctgagattcccaggtgtttccattcaatgatcagcactgaacacagaggactcaccatggagttgggactgagctggattttccttttggctattttaaaaggtgtccagtgtgaagtgcagctggtggagtcgtggggganacttgggtagagcctggcaggtccctgagactctcctgtgcagcctctggattcaaatttatgataatgccatgcacgtgggtaccanaacgcctaccgaggggaacggcctgggagtggggtctcgagtgttagtggaanagtggtaccatagcctagtcgacggtactcgtggtaggaaacgggtcccgtattcaccatcctaccagacgaaccaaacgaccaaagacgccttaccccgtgttaactcgttagaccaaaagttacgaaacgtagtctagaacgtacccgtaggaacgtacgaaccggtcctttacgttactttcgtacggttacgaaccggtaaaaccgggtcccccggttaagtcggggacgtaaggtacgtaccgtaaaggttacgttttaccgg

SEQ ID NO: 339141 - DNA, 735 bp, Homo sapiens
  misc_feature: GZ8MTXP02HUPWS.38.53.E09.1.454.CMB.2.raw
  modified_base (219)..(219): a, c, t, g, unknown or other
  misc_feature (219)..(219): n is a, c, g, or t
  modified_base (282)..(282): a, c, t, g, unknown or other
  misc_feature (282)..(282): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttggtagagccgtggcaggtccctgagctctctgtgcagcctctggattacaaatttaangtaataaatcgaccatgcctacggtcggggtaccaacgaacgccgtaccggaaggggaacgggtcccggttaggggagggtttcggggtacctacgtaaagggttggtttaaggttaccggaaacgtaggttacggtaacctaagttacgaccttagtcgacggtacttcgttagggtacggaaacgggtccgtacgttacccaacctacgtcctaccgaacgaaccgaaaccgaaccgaaccgaaacgtaccgtacccttacccgttagttaaccgttacgtaacggtaaactaaaacgttacggaaacgtacgttaccgtaaggtaccgtaaccgtacgggaaaccggaaccgtacccgggttcctttacgtttaactttcgtacggtacgaaccgtaaaccgggtcccgtaaggtcgacgtacgtaacgtacgtaacggttacgtttacg

SEQ ID NO: 339142 - DNA, 547 bp, Homo sapiens
  misc_feature: GZ8MTXP02I0Z45.38.53.E09.1.454.CMB.2.raw
  modified_base (216)..(216): a, c, t, g, unknown or other
  misc_feature (216)..(216): n is a, c, g, or t
  modified_base (445)..(445): a, c, t, g, unknown or other
  misc_feature (445)..(445): n is a, c, g, or t
tcagtcgatcacgtcacgaccggtgctcgatttagagagagtgtgttgggtttggggggagaggagccccagcccctgagattcccaggtgtttccattcagtgatcagcactgaacacagaggactcaccatggagttgggactgagctggattttccttttggctattttaaaaggtgtccagtgtgaagtgcagctggtggagtctggggganacttggtagagcctggcaggtccctgagactctcctgtgcagcctctggattcaaatttaatgataatgccatgcactggtccacaagcctaccgaggggaaggcctgggagtgggtctcaagtgttagttggaacagtgtaccatagcctatgcggactctgtgaagggccgattcaccatctcagagacaacgcaacgagctccctagtactctgacaaatgaaacngtactgacgacctagacgacacggccttactactttctgttacgacgaaaacggtaccccggtaagtacgggacaacgtacgtactaaagtacggttttacg

SEQ ID NO: 339143 - DNA, 694 bp, Homo sapiens
  misc_feature: GZ8MTXP02JZFSM.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagacttggtagagcctggcaggtccctgagactctcctgtgcagcctctggattacaaatttaangaataatcgaccatgcacgtgggtccgaacaagctaccgaaggggacggccgtgggagtgggtctacgaaggtgttaggtacggaactagtacggtaaccagtacgccttagtcggaccggtactcgtgggtacgggaaacggggtcccgtaatttcccaaccctagtcctacccgaagaacgaaccaaaccgacccaaagacgtcccttccccgtagttactcctagaacctaaaagtcggaaaactacggttacctagggaacgtacccgttagggaaaccggaccgtaaccgggtcccttttacgttaacgttttcgtacggttacgaaaacccgaaaacccggggttccccggtaaagttccggggacctaagggttacgtacgtttaaaacgggtcggtttttacccg

SEQ ID NO: 339144 - DNA, 647 bp, Homo sapiens
  misc_feature: GZ8MTXP02GQ9WI.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggctaattttaaaaggtgtccagtgtgaagtgcagctggtggagtcgtgggggagacttggtagagccgtggcaggtccctgagactctcctgtgcagcctctggattacaaatttaangaataatcgaccatcgctacgtcgggtaccaacaacgccgtaccggaaggggaacgggtccgtagggacggttggggttactacgtaaggttcggtttaaggtacggtaaacgtagttacggtaaccagttacgtcctagtcggaccggtacttcgtggtagggaaacgggtcctacttccaacccgatccctacgaagacgaaccaacgaccaaggacctcctccctgtaactcgtagacaaagtcgaaactacgtcgtagacgtacctaggacgtaacgtacggtcctttattacttcgtagtacgaacgtaaaccggtcccgtaagtcgggactaaggtacgtacgttaaaggtcgttttacg

SEQ ID NO: 339145 - DNA, 727 bp, Homo sapiens
  misc_feature: GZ8MTXP02JJZH1.38.53.E09.1.454.CMB.2.raw
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccgagggaaggcctggagtgggtctcaagtgttagttggaacagtggtaccatagcctatgcggactctgtggaagggccattcaccatcctccagacgacaacgccaagagcctccctgtatcgtgacaaaatgaaacagtcctggaacgaccgtggaacggacaacgggtccctttacttaattttcctggtacgtaaccgaaaaacggggtcccccggttaagtcgggaccaaggtaacgtacgtaaaaggtacgggtttccgtttagaaccgttcccgggtcgggggacccgtaaacgggggtaaacccccgggttccaaccccggttccctacccccgacgtacccgtacccctacccgaacccggtaccccggacccgttaccggtccccgttccccgttccccggtccggtccccgtcccgtaccgccgtaccggaacggcccgaccgttacccgacggacgacgaccgacgcggtcccggtcggcgtcgtccggtacgtaccgggtaacgaacggttaccttaccgtaaccgtacggtacttacgccggtacgtcgggcggaccggg

SEQ ID NO: 339146 - DNA, 637 bp, Homo sapiens
  misc_feature: GZ8MTXP02H475S.38.53.E09.1.454.CMB.2.raw
  modified_base (278)..(278): a, c, t, g, unknown or other
  misc_feature (278)..(278): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaatttaangataatcgaccatgctacgtcgggtaccgacaagcctccgaggggaacggccgtgggaggtgggtctacgaaggtgttaggttcggaactaggtacggtaaccagttacgccctagtcggaccggtacttccgtgggtacggaaacgggggtccctaacgttacccaccatcctacccgaagaacgaaccaaacgacctaaagacgcctacccgtagtactctagacctaaagtcgaaaccagtctagaaacgtacctaggaacggaccgtacggtcctttacgttactttcgtaacgtcgaacgtaaaaccggtcccggtaagtccggatacggtacgacgttaaggtacggtttacg

SEQ ID NO: 339147 - DNA, 724 bp, Homo sapiens
  misc_feature: GZ8MTXP02IUMK6.38.53.E09.1.454.CMB.2.raw
  modified_base (282)..(282): a, c, t, g, unknown or other
  misc_feature (282)..(282): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggtattacaaatttaangataatgccatgacacgtgggtaccgaacaacgcctacccgaaggggaacgggtccgtagggaggttcgggtctacgtaaggttggtttaaggttacgggaaacgtaggtacgggtaaccagttacggaccctagtcggacggtacttcgtggtagggaaacgggggtccctaattcccgaaaccctactccgtacccgaaaggacgaaacccgaaacgacccgaaaaggaccgtcccttaccccgttaggttacctacgttagaacctaaaagttcgaaaaccgtgtacctaggaacgtaccgtagggaaccggaaaccgtaccgggttccctttacgttaaactttttcggacgttacgaaaaccggtaaaacccggggtccccggttaagtaccggacgtaagggtaacgaccgtttaaaagggttacggtttttaccg

SEQ ID NO: 339148 - DNA, 581 bp, Homo sapiens
  misc_feature: GZ8MTXP02G3B9N.38.53.E09.1.454.CMB.2.raw
  modified_base (214)..(214): a, c, t, g, unknown or other
  misc_feature (214)..(214): n is a, c, g, or t
  modified_base (278)..(278): a, c, t, g, unknown or other
  misc_feature (278)..(278): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaggtgtccagtgtgaagtgcagctggtggagtctggggganacttggtagagcctgggcagggtccctgagactctcctgtgcagcctctggattcaaatttaangaataatgaccatgcactgggtccaacaaagcctaccaaggggaagggcctgggagtgggtctacgaagtgttagtggaacagtggaaccatagcctagtcgacggactcgtgtaggaaagggcccgtattcaacccatctaccaagacgacaacgacccaaagacgcctcccgtgtactactgaccaaatcgaaacagtctagacgacctgaagaccgacggtccctttatctttccgtgtacgacgaaaaacggccccggtaatcgggactaaggtacgaccgtaaaacggtggtttaccg

SEQ ID NO: 339149 - DNA, 621 bp, Homo sapiens
  misc_feature: GZ8MTXP02GDIVS.38.53.E09.1.454.CMB.2.raw
  modified_base (359)..(359): a, c, t, g, unknown or other
  misc_feature (359)..(359): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggattcaaatttaatgataatgccatgcacgtgggtaccgacaagctaccgaggggaacggccgtgggagtgggtctcgaagtgttagtggaacnggtaggtacatacgcctagtcgcggactcgtgtagaaacggggccgtagttccaccgatcctccgaagacgacaacgaccgaagacgcctacccgtgtactctagacctaaagtcgaaaccagtaccgtagaacggaccctaggaacggaaccctacgggtacccttttacttacgtttttacacggtttacgaaaccgtaaaaccgggtcccccggtaagtacggaccgtaaggtacgtacgtaaaggtacggttttaccg

SEQ ID NO: 339150 - DNA, 740 bp, Homo sapiens
  misc_feature: GZ8MTXP02HWQS5.38.53.E09.1.454.CMB.2.raw
  modified_base (215)..(215): a, c, t, g, unknown or other
  misc_feature (215)..(215): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtggggganacgttggtagagcctggcaggtccctgagactctcctgtgcagcctctggattacaaattttaatgaataatgaccatgcacgtgggtaccaacaagcctaccgaaggggaacggtcccgtaggggacggttggggtacctacgtaaaggtcggtttaaggttcggaaactaggtcggtaaccagttacgaccttagtcggacgtaccgttccgttagggtacgggaaacgggggtcccgtactttacccgaaccctacgttacccgtaccccgaaaggtaaccgaaaccgaaacccggacccgtaaaacggaccggtacccttaccccgttaggttacttaccgttagaaacctaaaagttacgaaacgtaacgttaccgttaaggacggtaaacccgtagggaacggaacccggtaccggttccctttaccgttaactttcgtacgttaccgtaaccgtaaaaaccgggtccccggtaaagtcggacgtaaggtacgtacgttaaacggttacggttttaccg

SEQ ID NO: 339151 - DNA, 625 bp, Homo sapiens
  misc_feature: GZ8MTXP02IAEPM.38.53.E09.1.454.CMB.2.raw
  modified_base (278)..(278): a, c, t, g, unknown or other
  misc_feature (278)..(278): n is a, c, g, or t
  modified_base (399)..(399): a, c, t, g, unknown or other
  misc_feature (399)..(399): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaatttaangataatgccatgcacgtgggtccacaagctaccgaggggaagggccgtagggagttggggtctacgaaggtgttagttcggaaacagttcggtaaccataggcctagtcgacggacttcgnggtgaaaggggcccgtattcgaccctatctccaagacgaccaacgaccaaagacgcctaccccgttgtactactgactaaatagaaacctagtacctagaacgtaccgtaggaacggacgaccggtacctttacctacgttttaccgtaggttacgaaccgtaaaaacggtcccccgtaaggttaaccgtaggtaccgtaaggtacgtacgtaaacggtttaacgg

SEQ ID NO: 339152 - DNA, 572 bp, Homo sapiens
  misc_feature: GZ8MTXP02F3IV6.38.53.E09.1.454.CMB.2.raw
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagcgtggtatttcctttggctatttaaaggtgtcagtgtgaagtgcagctgggtggagtcgtgggggagtacttgggtagagcctggcaggtccctggagactctcctgtgcagtcctctggattacaaatttangataatgccatgcacgtggtccanaggctccgagggaggcctggaggtggtctgagtgttagtgacngtacgacagtgctgngcgatcgtggngaacgggcctatcaaccntcacagacacaacgactaagcgtcctctagtactctagacaacgtacgaacgacgtacgtacgtacgacgtacggacggaccgtaccgtaccgttacttacgttcgttacgtacgtaaccggtaaccggtaccggtaacgtacggtacgtacggtacgtacgttacggttacgtttacg

SEQ ID NO: 339153 - DNA, 611 bp, Homo sapiens
  misc_feature: GZ8MTXP02HNOR1.38.53.E09.1.454.CMB.2.raw
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaaggccattcaccatctccagagacaacgcaagagctccctgtatctgacaaatgaacagtcngagacctgaggacacggtccttntatttctgtcgacaaaacggccccgtatcggacagtagctaagtaggttctttgaccgttcgtcggggccgaacggggtaccccggtcctacccgtcctccctccacgccctacccaacccgaacgggcccctacgtcccggtcccttcccccgtggcccgccccgtagccctccgacgggaccgaccacccgtcccgagacgccaaccgcggtcccggcccgtcggggccttcggcctcggtaccgaacggaccttaccgttccgaacggttcgacgttccgacgtcggacggtcgggccg

SEQ ID NO: 339154 - DNA, 561 bp, Homo sapiens
  misc_feature: GZ8MTXP02GU9HP.38.53.E09.1.454.CMB.2.raw
  modified_base (353)..(353): a, c, t, g, unknown or other
  misc_feature (353)..(353): n is a, c, g, or t
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccaggggaaggcctggagtgggtctcaagtgttagttggaacagtggtaccatagcctatgcggactctgtgaagggccattcaccatctccagagacaacgccaagagctccctgtatctgcaaatgaacagtctgagacctgaggacacggtcctttctatttctgtgacaaaacggtcccgtatggcagtagctaagngttcttgactcgtggggccaggggaccggtcaccgtctcctcacgccctaccaccacgggcccagtccggtccctccccgtggccgccctcgctccgaggacncctaccnccgagacgcacgacgcccggcccgtcggggcctcggccttcgggtacaacgggtacctaacgttcccacgggtctactaccgacgtcggacgtccggg

SEQ ID NO: 339155 - DNA, 664 bp, Homo sapiens
  misc_feature: GZ8MTXP02JZL4J.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagacgttggtagagccgtggcaggtccctgagactctcctgtgcagcctcgtggattacaaatttaatgtaataatgaccatcgctacgtggtccgaacagctccgaggggaacggccgtggggagtgggtctacgaaggttggttagttacggaactggtacggtaacctagtacgtcctagtcgacgggtactcgtggtacggaacgggcccgtattccaccgtactcctacccgaagacgaaccaaccggcaaaggacgtccctacccgtagttactcgtgaacctaaagtacgaaaacgtacgtacgtacggaacgtacccgttagggaaacggtaccgtaccgggtacccctttagtacgtttaaccgttggaaccgtaccggtaaaaccgggtccccggtaagtacggacgtaacggtacgacgttaaaggttcggttttaaccg

SEQ ID NO: 339156 - DNA, 562 bp, Homo sapiens
  misc_feature: GZ8MTXP02I0TBI.38.53.E09.1.454.CMB.2.raw
  modified_base (216)..(216): a, c, t, g, unknown or other
  misc_feature (216)..(216): n is a, c, g, or t
  modified_base (426)..(426): a, c, t, g, unknown or other
  misc_feature (426)..(426): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttggtagagcctggcaggtccctgagctctcctgtgcagccctctggattcaaatttaatgataatgccatgcatgggtccgacagcctccgaggggaagggcctgggagtgggtctcaagtgttagttggaacagtggtacatagctatgcggactctgtgaagggccgatcaccatctccagagacaacgaccaagacgctccctntactactcgaccaaatagaaacagtactgaagaccctaggacggaccaacggtcctttacttactttactcgtacgaaccgtaaaacggtcccccgtaagtacgtacgacgtagtaacgtacgtaacggtttaccg

SEQ ID NO: 339157 - DNA, 632 bp, Homo sapiens
  misc_feature: GZ8MTXP02FZ67V.38.53.E09.1.454.CMB.2.raw
  modified_base (294)..(294): a, c, t, g, unknown or other
  misc_feature (294)..(294): n is a, c, g, or t
  modified_base (471)..(471): a, c, t, g, unknown or other
  misc_feature (471)..(471): n is a, c, g, or t
  modified_base (614)..(614): a, c, t, g, unknown or other
  misc_feature (614)..(614): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagcgtgggtggagtcggtgggggatacgttggtagacgccgtggcgacggtccctgacgtactctcctgtgcacgcctgtgtaattactaaatttaangaataagtcgacctagtcgacctacggttacgggtccgaaacgaacgccgtaccggaaggggacggtcgtagggaggttcgggtactacgtaaggttggttacgtacggaacgtggtacgtaaccagtacgacgtagcgacgtactcgtggtaaggacggtcctaattccgaacctntaccacgaagaacgaccgaaaccgacgaagctccttaccgtagtactctagaacaaagtacgaaactgtactacggaacgcgtagggacgtacgtacgtctttatcttagcgtacgaaacgaccgtcgtaagtacgactaggngtacgtaaggtctttacg

SEQ ID NO: 339158 - DNA, 557 bp, Homo sapiens
  misc_feature: GZ8MTXP02JH92P.38.53.E09.1.454.CMB.2.raw
  modified_base (349)..(349): a, c, t, g, unknown or other
  misc_feature (349)..(349): n is a, c, g, or t
  modified_base (444)..(444): a, c, t, g, unknown or other
  misc_feature (444)..(444): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaatttatgataatgccatgcatgggtccacaagctccgagggaagggcctgggagtgggtctcgagtgttagtggaacngtgaccatagcctagtgcggactcgtgtggaacgggccagttcaccatctccagacacaacgccaagacgctccctgtatctgacaaatgaaacngtctagacgacctagacgacaccggtacctttcgtaactttcgtagtcgaaaccgaaaacgggtccccggtaagtcggtacgtaggtacgacgtaaaaggttcggttttaccg

SEQ ID NO: 339159 - DNA, 659 bp, Homo sapiens
  misc_feature: GZ8MTXP02HCTU1.38.53.E09.1.454.CMB.2.raw
  modified_base (279)..(279): a, c, t, g, unknown or other
  misc_feature (279)..(279): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaggtgtccagtgtgaagtgcagctggtggagtcgtgggggagacgttggtagagcctggcaggtcctgagactctctgtgcagcctgtggtattacaaatttanagataatgccatgcagtcggtccgaacacgcctaccgaggggaacggccgtgggaggtgggtctacgtagtgttagttacggaacgtagtacggtaccatagaccctgtcgacggacttcgtggtaggaacggggtccctattccgaaccctagtcctaccgaagacgaacccgaaccgaccgtaaagaccgtcctacccgtacgtaactcccgtagaactaaaactcgaaactacggtactacgaacgtaccgtagggaacggtaccctaccggtccctttattaacgtttccgtaggttaccgaaaccgtaaacccggggtccccggttaagccgggtaacgtacgtaacggtagtttaaacgggtcggtttttaccg

SEQ ID NO: 339160 - DNA, 710 bp, Homo sapiens
  misc_feature: GZ8MTXP02GX3D8.38.53.E09.1.454.CMB.2.raw
  modified_base (216)..(216): a, c, t, g, unknown or other
  misc_feature (216)..(216): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttgggtagagcctgggcaggtccctgagactctcctgtgcagcctctggattcaaatttaatgataatgaccatgacacgtgggtccgacaagccgtaccgaggggaacggggcctgggaggtggggtctacgtaaggttggtttaggtacggaaacaggttacggtaaccagttacgcccttagtcggaccggtacttccgtagggtacgggaacgggggtacccgtacgttccaacccgtattaccctacccgaaggtaacgaacccgaaaccggaccccgaaaaggaccgtacccgttacccccgttaggttaaccttaccgtacggaacctaaaagttacgtaaaacgtacgtccgttaggaacgtacccgttagggaacggtaccgtaaccgggttccctttacttacgttttcgtacgtacggaaaccgtaaaccgggtccccgtaagtcggactaggtacgtaccgtaaggttacggttttaccg

SEQ ID NO: 339161 - DNA, 651 bp, Homo sapiens
  misc_feature: GZ8MTXP02JVA5U.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattacaaatttaatgaataatcgccatgcacgtgggtccgaacaagcctaccgaaggggaacggcctgggaggtcggggtctacgaagtggttagttacggaactagtcggtaacctagtacgcctagtcggcgggtactcgtggtacggaaacggggcccgtaattccaacctatcctaccgaagaacgaaccaaaccgaccaaagacgacccttaccccgtagtactcgtagaacctaaaagtacgaaactaggttacctaggaacgtacccgtagggaacggaccctaccgggtcctttacgttacgtttctacggtacgaaaccgtaaaaccggggtccccgtaagtcgggactaggtacgtacgtaaggtacgtttacgg

SEQ ID NO: 339162 - DNA, 524 bp, Homo sapiens
  misc_feature: GZ8MTXP02I23B6.38.53.E09.1.454.CMB.2.raw
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagtcgatcacgtcacgaccggtgctcgatttagagagagtgtgttgggtttgggggaagaggaagactgacggtcctgccacaggtggtgctgggcacggtgggcactcgacacaacatttgcgctcaactgtcttgtctcaccatggagttgggactgagctggattttccttttggctattttaaaaggtgtccagtgtgaagtgcagctggtggagtcgtgggggagacgttggtagagcctggcaggtccctgagactctcctgtgcagcctctggattcaaatttangataatgccatgcacgtggtccacaagctccgaggggaagggcctggagtcgggtctcaagtgttagtggaacngtgtaccatagcctatgcgactcgtgtgaagggccattcaccntctcaganacaacgccaagngcctccctgtactctgcaaaatgaaacagtctgagacctgagacacggtccttcttaatttcgtgttcgacgaaacggtccccgtagtcgacg

SEQ ID NO: 339163 - DNA, 695 bp, Homo sapiens
  misc_feature: GZ8MTXP02I0W8D.38.53.E09.1.454.CMB.2.raw
  modified_base (350)..(350): a, c, t, g, unknown or other
  misc_feature (350)..(350): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcatgggtccacaacgctccgaggggaacggcctgggagtggtctcgagtgttagtggaacngtgtaccatacgcctagtcgcggtactcgtggtaggaaacggggtccgtattccgacctactcctaccgaagaacgaccgaaaccgaccgaaagaacgcccttaccccgttagttacttaccgtaggaacctaaaagttacgtaaaaccgacgttaccgttacggaaacgtaacccgttagggaaaccgggaacccgtaacccgggttacccctttaccgtttaaacgttttccgttacgggttaccgaaacccggtaaaaacccggggtacccccgggttaagtccggggtaaccgtaaacggttacggtaaccgtttaaaacgggttacgggtttttaacccg

SEQ ID NO: 339164 - DNA, 646 bp, Homo sapiens
  misc_feature: GZ8MTXP02JGI06.38.53.E09.1.454.CMB.2.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtggggganacttggtagagcctggcaggtccctgagactctcctgtgcagcctcgtggattacaaatttaangaataatgaccatcgcacgtcggtaccgaacaacgccgtaccgaaggggaacgggccgtagggaggtcgggtacctacgtaaggttggtttaaggttacggaaacctagggttacgtaacctagtacgtcctagtcgaccggtactcgtggtaggaacgggtcctattccgactctccgtacaagacaaccgaacgaccgaagacgccttcccgtagtactcgtagaactaaagtgaaacagttcgtgaaacgtccgtagacggaactaccggttcctttagttaacttcgtaggtacgaaaccgtaaaaccgggtcccggtaagtcggacgtaggtacgtaacgttaaggttacggttttacg

SEQ ID NO: 339165 - DNA, 593 bp, Homo sapiens
  misc_feature: GZ8MTXP02GIT7O.38.53.E09.1.454.CMB.2.raw
  modified_base (243)..(243): a, c, t, g, unknown or other
  misc_feature (243)..(243): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccgaggggaagggcctggagtgggtctcaagtgttagtggaacagtggtaccatagcctatgcggactctgtgaagggccattcaccatcnccagagacaacgccaagagctccctgtatctgacaaatgaacagtctgagacctgagacacggtccttctatttctgtgacgaaaacggccccggtatcggcagtagacgtaagtaggtttcttgactccggtggggccgaacggggacccgggtcaccggtcctcctcacgccctaccaccgacgggcccacgtccggtccttccccgtggccgccctcgcctccgacggacgccaccgtccgacgacgacacgacgccggtcccgtgggcctcgccgttacggacgaaacggtaccttaccgttcccgaacggttacgacgttaccgacgtacggacggcgggtccgg

SEQ ID NO: 339166 - DNA, 641 bp, Homo sapiens
  misc_feature: GZ8MTXP02JUIRO.38.53.E09.1.454.CMB.2.raw
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacgttggtagagccgtggcaggtccctgagactctcctgtgcagccctcgtggtacttcaaatttangaataatgaccatcgactacgtgggtccgacaacgctccgaagggaacgggcctgggagtggtctactaaggtgttaggttggaacnggtacggtaccagtacgcctagtcggacggtactcgtggtagaaacgggccgtacttcgacctatacctaccaagaacgaccaaaccgaccgaacgacgcctcccgtagtaactctagactaaactagaaacacgtacgtaggacgtaccgtaggaacggaccgacccggtacctttaccttactttaccgtagtacgaaccgtaaaaccgggtacccccggtaagtccgggacgtacggtacggtacgttaaacgggtacgttttaccgg

SEQ ID NO: 339167 - DNA, 636 bp, Homo sapiens
  misc_feature: GZ8MTXP02HBU2H.38.53.E09.1.454.CMB.2.raw
  modified_base (215)..(215): a, c, t, g, unknown or other
  misc_feature (215)..(215): n is a, c, g, or t
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtggggganacgttggtagagcctggcaggtccctgagactctcctgtgcagccctctggattacaaatttaangataatgaccatgcacgtcggtccgaanaacgcctaccgaaggggaacgggcctgggagtgggtctacgtaaggtggtttagtagggaacaggttcggtaaccagtacggccttagtcggacggtactcgtggtagaacgggccgtattcaccatcctacagacgaccaacgacccaaagcgcctcccgtagtactctagacaaagtacgaaacgtcgtacgtagacgtaccgtaggaacggaccgtaccggttccctttacgtttactttccgtaggttacgaaacccgtaaaacggggtcccccggttaaagtcgggaaccgtaggtacgtacgttaacgggtacgttttccgg

SEQ ID NO: 339168 - DNA, 682 bp, Homo sapiens
  misc_feature: GZ8MTXP02HTKSL.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacgttggtagagcctggcaggtccctgagactctcctgtcgcacgcctcgtggtattacaaaattttaatgaataaatcgacctaatgaccacgtcgggtacccgaacgaaacgccgtaccggaaaggggaacgggccgtaggggtacggttggggtaccttacgtaaggttgtttaaggttacggaaacgtaggtacggtaactagttacgtacctagtcggacggtaccgttcgttggtacggaaacgggtccaactttcccaaccctatccctacgaacgacgaaacaaccgaccaagacgtcctacccgtgtactcgtgaactaaagtacgaactagtctagaaccgtaccgtaggaacgtaccgtaccggttccctttacgttactttccgtagttaccgaaaccgtaaaaccggcccgtaagtcggaacgtagtacgtactaaggtttacgtttacg

SEQ ID NO: 339169 - DNA, 684 bp, Homo sapiens
  misc_feature: GZ8MTXP02JTQYN.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacgttggtagagcctggcaggtccctgagactctcctgtgcagcctctggattacaaatttatgataatgccatgactacgtcgggtccgacaagcctaccgaggggaacgggccgtgggaggtgggtctacgtaaggttcggttaggttaccgggaactaggttacggtaacctagtacgtccttagtcggacgggtacttcgtggttacgggaaacgggcccgtattacccaacctacttcccaccaagacgaaccaaccggcccaaagacgccttacccgtgtactcgtagactaaagtgaacagttcgagacgtacctaggaacggacctaaccgggttcctttacgtttaacgttttcgtacgggttaaccgaaacccggtaaaacccggggtcccccggttaaggtacgggacccgttaaagggtaacgtaccggtttaaaaggggttacgtttttcccggg

SEQ ID NO: 339170 - DNA, 665 bp, Homo sapiens
  misc_feature: GZ8MTXP02H2TY9.38.53.E09.1.454.CMB.2.raw
tcagtcgatcacgtcacgaccggtgctcgatttagagagagtgtgttgggtttgggggaagaggaagactgacggtcctgccacaggtggtgctgggcacggtgggcactcgacacaacatttgcgctcaactgtcttgtctcaccatggagttgggactgagctggattttccttttggctattttaaaggtgtccagtgtgaagtgcagctggtggagtcgtgggggagacgttggtagagccgtggcaggtccctgagctctcctgtgcagcctctggattacaaatttatgaataatgaccatgacctacgtgggtacccaacgaagccgtaaccggaaggggaacgggccgtagggaggttcggggtctacgtaaggttggtttaaggttaggaaacgtgggttacgggttaaacccaagttacgtacccttagtacggtaccgggtactccgtaggtagggaacggggcccggtaactttacccgaaccgactacccgtaccgaagaacgaaaccgaaaccgaccgaaacgacgtaccctacccgtagtactcgtagaacaaagtacgaacagttctagacgtaccgtagacggacgtaccggtccttacttacgtttcgtacggtacgacggtaaaaccgggcccgttagacggtacg

SEQ ID NO: 339171 - DNA, 695 bp, Homo sapiens
  misc_feature: GZ8MTXP02FXD5Q.38.53.E09.1.454.CMB.2.raw
  modified_base (218)..(218): a, c, t, g, unknown or other
  misc_feature (218)..(218): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctgggtggagtcgtggggganacgttggtagagcctggcaggtccctgagactctcctgtgcagcctctggattacaaatttaatgaataatgaccatgacacgtcgggtaccgaacaacgcctacccggaaggggaacggggtccgtaggggaggtggggttacctacgaaaggttggtttaggttaccgggaaacgtaggttacggtaaccctaagtaacggtaccttagtcgggccgggtaacttcgttagggtacgggaaacgggggccctaatttccgaccctagttaccaccgaagaacgaccgaaaccgaccgtaaaggaccgccttacccgtagttaactcgtacgtactaaaacgtacggaaacctagtcgtagaacgaccgtaggaacgaccgaacggttccttacgttactttcgtagtacgaaaccgaaacgggtccccggtaagtcggacgtaaggtacgtaacgtaacgggtacgttttaccgg

SEQ ID NO: 339172 - DNA, 781 bp, Homo sapiens
  misc_feature: GZ8MTXP02GHUGE.38.53.E09.1.454.CMB.2.raw
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggatttttccttttggcttattttaaaaggtgtccagtgtgaagtgcagctgggtggagtcgtgggggagacgttgggtagagcctggcagggtccctgagactctcctgtgcagcctctggattacaaatttangataatgccatgcacgtgggtaccanaagcctaccgaggggaacggtcctgggaggtgggtactacgaaggttggttagtacggaacgtaggtggtaaccagtaacgcctagtcggacggtaccttcgtagggtacggaacggggtccgtaacgttaccaacccgtactccgtaccgaaaggaacgaacccgaaaccggacccgaaaacgacgtacccgttacccgttaggttaaccttcggttaacggaaaccttaaaaacggtacgtaaaacccgttacgggttaccgttaacggaaacggtaaccccgtaaggggaaaccggggtaaaaccgtaccccgggttacccgtttttaccgtttaacgtttttaccggtacggtttaaccggaaacccggttaaaaaccccgggggtccccccgggttaaaggttaccggggaccggtaaaacgggttaccggtaaacggttaaacgggtttaacggtttttacccgg

SEQ ID NO: 339173 - DNA, 640 bp, Homo sapiens
  misc_feature: GZ8MTXP02G2CV0.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggattcaaatttatgataatgaccatgcactgggtccgacaagctaccgaggggaacgggcctgggagtgggtctacgaagtgttagtcggaactagtcggtaccagtacgccttagtcgacggtactcgtgtaggaaacgggcccgtattccaaccgtactccgtaccagaacgaaccaaaccgaccaaaggacgtaccctaccctagtaaactcgtagactaaaacgtaggaaaccagtacctaggaacgtacccgtaggaacggtaaccaccgggtccctttacgttaaactttccgtaggttacgaaccgtaaaaccggggtcccccgttaaagtcggaacgtagtacgacgttaaaggtaacggttttccg

SEQ ID NO: 339174 - DNA, 606 bp, Homo sapiens
  misc_feature: GZ8MTXP02IF754.38.53.E09.1.454.CMB.2.raw
  modified_base (294)..(294): a, c, t, g, unknown or other
  misc_feature (294)..(294): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagtcgatcacgtcacgaccggtgctcgatttagagagagtgtgttgggtttggggggaagaggaagactgacggtcctgccacaggtggtgctgggcacggtgggcactcgacacaacatttgcgctcaactgtcttgtctcaccatggagttgggactgagctggattttcctttggctattttaaaggtgtccagtgtgaagtgcagctggtggagtcgtgggggagacttggtagagccgtggcaggtccctgagactctcctgtgcagcctctggattacaaatttangaataatgacctatcgcacgtcgggtaccaacaagtcctaccgaggggaacggcctagggagtcgggtctacgaagttgttagttaggaactggtgtacagtacgacctagngcggactcgnggtagacggccgtacttcacctatctaccgagacgaacaaccgaccaagacgtcctcccgtagtactcgtacgacaaatacgaactagtactacggacgacgtacggacggaaccgtaccgggtcctttacgttacgtttaacgttacggtacgtaaccgaaaacgggtccccggtaagtacggtaacgg

SEQ ID NO: 339175 - DNA, 715 bp, Homo sapiens
  misc_feature: GZ8MTXP02IO1PC.38.53.E09.1.454.CMB.2.raw
  modified_base (261)..(261): a, c, t, g, unknown or other
  misc_feature (261)..(261): n is a, c, g, or t
  modified_base (613)..(613): a, c, t, g, unknown or other
  misc_feature (613)..(613): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctgggtggagtcgtggggggagacttgggtagagcctggcaggtccctgacgactctcctgtgcngcctctggattcaaatttatgataatgccatgcacgtgggtccgaacaagcgtacccgaggggaacgggtccctaggggaggttggggtccttacgaaggttggtttaaggttcggggaaaaccgtaggttacggggtaaccaagttaacggacccgttacgtcgggtacccgggtaaccttccgttaggggttacggggaaacgggggtacccggtaacttacccaacccttactacctcccgaaggaacgaacccaaaccggacccaaaggaccgcccttaccccgttaggtaaacttctcgaacctaaagtaccgaaacgtagtctaagaacgaccgtagacggaaccncggttaccctttactaactttccgtagtccggaaaaccgtaaaaccgggccccggttaagtcggacgtaacggtacgtaaccggttaaggtacggtttttcg

SEQ ID NO: 339176 - DNA, 685 bp, Homo sapiens
  misc_feature: GZ8MTXP02IHSV5.38.53.E09.1.454.CMB.2.raw
  modified_base (284)..(284): a, c, t, g, unknown or other
  misc_feature (284)..(284): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggaggtcgtgggggagacgttgggtagagccgtggcaggtccctgagctctctgtgcagcctctggtattacaaatttaangtaataatcgaccagtcgacacggtcgggtacccgaacgaacgccgtaccggaaggggaacgggccgtaggggtaggttcgggtctacgtaaggttggtttaaggttcggaaacgtaggttacggtaaacctaagttaccgcttagtcggtaccgtaacttcgtaggtaggaaacgggtccgtactttaccgaacctacgtcctaccgaagacgaaaccaaacccggacaaaaggccaccttcccgtagttactacgttacgaactaaagtacgaacgtacgttccgagacgtacctggaacgtaaccgtccggtacctttactacgtttcgtacgtaccgaaacgtaaacccggtcccgtaagtcggacgtacgtacgtacgtaacggttacgtttaccg

SEQ ID NO: 339177 - DNA, 757 bp, Homo sapiens
  misc_feature: GZ8MTXP02GSFKZ.38.53.E09.1.454.CMB.2.raw
  modified_base (296)..(296): a, c, t, g, unknown or other
  misc_feature (296)..(296): n is a, c, g, or t
tcagtcgatcacgtcacgaccggtgctcgatttagagagagtgtgttgggtttgggggaagaggaagactgacggtcctgccacaggtggtgctgggcacggtgggcactcgacacaacatttgcgctcaactgtcttgtctcaccatggagttgggactgagctggattttccttttggctattttaaaaggtgtccagtgtgaagtgcagctgggtggagtcgtgggggagacttggtagagcctggcaggtccctgagactctcctgtgcagcctctggattacaaatttaangataatgaccatgcacgtgggtacccaacaagcctaccgaaggggaaacgggcctaggggagtcggggtcctacgtaaggttggtttaaggttagggaaactagggttcgggtaaaccctaagttacgcccttaagtcgggacggtaaccgttccgtggttacgggaaacgggggtcccgtaagtttacccaaccctaacgttccgttaccccgaaaggaacgaaaacccgaaacccggaacccgaaaacggtacggtacccctttacccccgttagggttaaccttaccgttacggaacctaaaaagttcggaaaaccgtagtaccgtacggtaaacggtaacccgttaggaaacggtaaacccgtacccgggttacccttttacgtttaacttttaaccgtaggttacggtaaacccggtaaaaaccgggcccccgggtttaaggtaccgggtaaccgg

SEQ ID NO: 339178 - DNA, 681 bp, Homo sapiens
  misc_feature: GZ8MTXP02HOLYN.38.53.E09.1.454.CMB.2.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacgttggtagagccgtggcaggtccctgacgactctcctgtgcagcctntgattcaaatttangataatgccatgcacgtggtccacaacgcgtaccgaggggacggccgtgggagtgggtctagtaagttggttagtacggaacgagttcggtactagtacgtcctagtcgcggtactcgtggtacggaacgggtcccgtattccgaaccctacttccgtacccgaaggaacgaaccaaaccgacccaaaggacgtacccttcccgttagtacttacgttagaactaaaacgtacgaaacgtacggttactacggaacgaccgttagggaaacggtaccgtaccggttacccttttacttacgttttaccgtacggtaccgtaaaccggtaaaacccgggtccccggtaagtacggacgttaacggtacgtaacggtttaacggtttacggtttttacccg

SEQ ID NO: 339179 - DNA, 706 bp, Homo sapiens
  misc_feature: GZ8MTXP02F49BV.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggatacgttggtagacgccgtggcacggtcctgacgactctcctgtgcagcctcgtgattacgtaaatttaatgaataatcgacctatcgactacggtcgggtacccaacgaacggtccgtacccggaaagggggtaacgggtccccggtaggggtacggttcggggttacccttaggtaaaggtttgggtttaaggttaccggggaaaactaggttacggtaaacctagtacgtaccttagtcgacggtacttcgtagggtaggaaacgggcctaattccgaaacctcgttaccacgaagaacaaccgaaccgacgtaaacgactcccttacccgtagtaatcccgtgaaactaaacgttagaaaccctgttcgtaaacgacgtacccgtaggaacgacgtacccgttctttatactttccgaggtccgaaaaccggtaaccggtacccgttgtacggaactaaggtcgtacgttaaacggtacgtttcg

SEQ ID NO: 339180 - DNA, 746 bp, Homo sapiens
  misc_feature: GZ8MTXP02JTA9N.38.53.E09.1.454.CMB.2.raw
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccaggggaaggcctggagtgggtctcaagtgttagttggaacagtggtaccatagcctatgcggactctgtgaagggccattcacatcncagagacaacgccaagagcctccctgtatctgacaaatgaaacngtctgacgacctgaggacacggtcctttctatttcngtcgacgaaaacggtccccggtatcggctagtacgtacgtaaggtacgggtttctttaggaccgtccggttacgggggacccgtaacgggggaaaccccggggttacctaacccgggttccttcccgtacccgaacgtccccgttacccgaaacccgtaaccgggggtcccctaacggttcccggttccccgttcccccgtcgggtcccctaccccgttcggccccttaccccggagggtacccgtacccgaaccccgttaccggaacggacgacccggaaccgacggggacccgggtcccggtcgggggtccttccgggccccggttacgggtacccggaaaacggggtaccctttaacccgttccggtaaaccggttcggtaaacgttaccggtaaccgttacggggaaccgggtcccggggg

SEQ ID NO: 339181 - DNA, 749 bp, Homo sapiens
  misc_feature: GZ8MTXP02HB9T7.38.53.E09.1.454.CMB.2.raw
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttggtagagcctggcaggtccctgagactctcctgtgcagcctgtggattacaaaatttaangaataatcgaccatgacacgtgggtaccgaacaagcctaccggaaggggaaacgggcctagggacggttgggtactacgaaaggttggtttaaggttacggaaactaggtcggtaaccaagtacggccctagtcggacggtaacttcgtaggtacggaaacgggtcccgtaacttaccgaaccctaactcccgtacccgaaagaacgaaacccgaaaccgaacccgaaacgggaccgtacccgttaccccgttaggttaaactccgttacggaaacctaaaacgtagaaaccgtaagttaccgtaaggaaacgtaacccgtagggaaaaccgggaacccgtaaccgggttacccttttactttaaacgttttcccgttaggttaaccgaaaccgtaaaaaaccgggtcccccggtaaagttcggaaccgtaggtaacgaaccgtttaaaaggtacggttttaccg

SEQ ID NO: 339182 - DNA, 745 bp, Homo sapiens
  misc_feature: GZ8MTXP02IZRHD.38.53.E09.1.454.CMB.2.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacgttggtagagcctggcaggtccctgagactctcctgtgcagcctctggattcaaatttangataatcgaccatgaccacgttcgggtaccgacaaggcctaccggaaggggaacgggcctaggggacggttggggtcctacgtaaggttggtttaggttacgggaaacgtaggttacgggtaacctagtacgacccgttagtcgggaccggtacttcgttgggtagggaaacggggtcccgtacgttccgaaccctacgtcctaccgaacgaacgaacccgaaaccggaacccgaaacggacggtacccttaccccgttagttaacgtccgttagaacctaaaagtacgaaaccgtacggtacttaacggacgtaccgttaggaacggtaaccgtaaccgggtcccttttacgtttaacgttttcgttacggtacggtaaacccgtaaaaccgggggtacccccggttaaagttccggaccgtaaagggtaccgtaacggttaaacggtttacgggtttttaaccg

SEQ ID NO: 339183 - DNA, 716 bp, Homo sapiens
  misc_feature: GZ8MTXP02IM8RX.38.53.E09.1.454.CMB.2.raw
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacttgggtagagcctggcaggtccctgagactctctgtgcagcctctggtattactaaatttaangaataatcgaccatcgacacgtcgggtaccgaacaacggcctaccggaggggaacgggccgtagggaggttcgggtactacgtaaggttggtttaaggttacgggaaactagggtacggtaacccagttacggacctagtcggaccgtactcgtcggtaaggaaacgggtcccgtaacgttacccaacctacttccgaccgaaacgaacgaaaccgaaaccgaccgaaaacgaccgtaccgttacccctagttacttacgtacgaaactaaactaggaaacctaggtactacggacgtaacccgtagggaaaccggaacgtaccggtaccttttacgtacgtttccgtaggttacgaaaccggtaaaacccgggtcccccggtaagtacggaccgtaacggtaacgtacgttaaaacggttacgtttaccgg

SEQ ID NO: 339184 - DNA, 682 bp, Homo sapiens
  misc_feature: GZ8MTXP02HVC19.38.53.E09.1.454.CMB.2.raw
  modified_base (297)..(297): a, c, t, g, unknown or other
  misc_feature (297)..(297): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctgggtggagtcggtgggggagacgttgggtagacgccgtgggctacgggtccctggagactctcctgtcgcacgtcctctggtacttactaaatttaangataatgacctatgacacgtcgggtaccgaacaagctaccggaggggaacgggtccgtagggtaggtcggggtctacgtaaggttgttacggttaggaacgtaggtcggtaacctagtacgtactagtggccgtaacgttcgtggacggaaggggcctattccacctatcaccaagaacgtaccaacggaccaaagaccgtcctacccgttgtaaactcgttacgaactaaaagtaccgaaaacgtacgtacgtacgacgtacggtaacggaaccggaccgttaccgttcctttagttactttacgtacggtacgtaaacccggaaacccggttaccggtaagtcggtaacgtacggtaacgtacggttaacggtttcgtttacg

SEQ ID NO: 339185 - DNA, 720 bp, Homo sapiens
  misc_feature: GZ8MTXP02J0440.38.53.E09.1.454.CMB.2.raw
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtggggganacgttggtagagcctggcaggtccctgagactctctgtgcacgcctctggattacaaatttangataatgccatgcacgtcggtccacagcctaccggaaggggacggtccgtgggaggttgggtactacgtaaggttggtttaaggttacggaacgtaggtacgggtaacctagtaaccggcctagtcggaccgggtacttgtggtacgggaaacggggtccctaatttacccgaccctacgtccgtacccgaaaggacgaacccaaacccggaccaaacggaccgtcccttacccgttagtactcgtagaactaaagtacgaaactacgtacgacggaacgttaacccgtagggaaaccggtaacccgtacccgggttaccccttttattacggttttaccgtaagggtaccggtaaaacccggtaaaacccggggtccccgttaaggtcgggaaccgttaggtaacgtaccggttaaaaggtttccggtttttaaccgg

SEQ ID NO: 339186 - DNA, 618 bp, Homo sapiens
  misc_feature: GZ8MTXP02GE5NH.38.53.E09.1.454.CMB.2.raw
  modified_base (276)..(276): a, c, t, g, unknown or other
  misc_feature (276)..(276): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagacttggtagagcctggcaggtccctgagactctcctgtgcagcctctggattcaaatttaangataatgccatgcactgggtccgacaagctccgaggggaagggcctgggagtgggtctcaaggttgttagttggaacaggtgtaccatacgcctagtgcggatcgtgtaggaacgggcctagttcacctatcctccaagacgaccaacgaccaacgacgctacccgtgtactctagaccaaagtacgaaacgagtacgtacgtaacgacccgtaggaacggtaaccgaccgggttaccctttaccgttacttttcgtacggttacgaaccgtaaaaccgggtcccccggtaagtacgggtaaccgtaggtaacgacgtttaaacggacggtttttaacccgg

SEQ ID NO: 339187 - DNA, 587 bp, Homo sapiens
  misc_feature: GZ8MTXP02GWQYR.38.53.E09.1.454.CMB.2.raw
  modified_base (348)..(348): a, c, t, g, unknown or other
  misc_feature (348)..(348): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
tcagtcgatcacgtcacgaccggtgctcgatttagagagagtgtgttggggtttgggggggagaggagccccagccctgagattcccaggtgtttccattcagtgatcagcactgaacacaggggactcaccatggagttgggactgagctggtattttccttttggtctattttaaaaggtgtccagtgtgaagtgcagctggtggagtcgtgggggagacttgggtagagcctggcaggtcctgagactctcctgtgcagcctctaggattacaaatttaatgataatcgccatcgcacgtgggtccaacaagcctccgaaggggacgggcctggagtgggtctanaaaggtgttaggttgaaccagtgtaccatcgcctatggcggtactcgtgngaacgggccatcaccatctcanagacacgacagacnccncctgtatctcgacaaactagaacagtctacgacgaaccgtggaacggacgtaccggtacctttacttatttccgtaggtacgtaaccgaaaaccgggtccccggttaagtcgacgtaagtacgtacgtaaaggtacgtttacgtttaccg

SEQ ID NO: 339188 - DNA, 628 bp, Homo sapiens
  misc_feature: GZ8MTXP02GWIBB.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctctggattcaaatttaatgataatgccatgcacgtggtccacaagctccgagggaagggcctgggaggtgggtctacgaaggtgttaggttacggaacaggtacgtaccagtacggcctagtggcggactcgtaggtaggaaacgggccgtaagtttcaaccctaactccgtacccaaggaacgaacccgaaacgacccgaaaggacgccttaccccgtagttaactccgtagaccaaaattcggaaaactacggtacctaggaacgaccgtaggacggaacaccggtcctttattactttcgtggtacgtaacgaaaacgggtccccggtaagtacggtcgacgtagacctaaggtacgtttacgg

SEQ ID NO: 339189 - DNA, 713 bp, Homo sapiens
  misc_feature: GZ8MTXP02I63Q2.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagtacgttggtagagcctggcaggtccctgagactctcctgtgcagcctctggattactaaatttaatagtaataatcgaccatcgacacgtcgggtaccgaacaacggcctaccggaaggggaacgggtccgtagggtacggtgggtctacgtaaaggttggtttaaggtacgggaaacgtaggttacggtaaccctagtaccgaccttagtcggaccggtaacttcgtaggtacgggaaacggggtcctaactttccaaccctatccgtaccgagaaacgaaccaaacgaccaaaggcgtcctacccgttagtacttcgtacgaaacctaaagtagaaaccgtagtactacggaacgtacccgtaggaaacggacccgtaccggttccctttattacgtttaccgtacgggtaccgtaaaaccggtaaacccgggtccccggttaagtaccgggactaaaggtacgtaaccggttaagggttacggttttaccg

SEQ ID NO: 339190 - DNA, 732 bp, Homo sapiens
  misc_feature: GZ8MTXP02G3NW9.38.53.E09.1.454.CMB.2.raw
  modified_base (288)..(288): a, c, t, g, unknown or other
  misc_feature (288)..(288): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagctgggtggagtcgtgggggatacgttggtagagccgtggcacggtccctgagactctcctgtgcagtcctcgtggtattactaaatttanagtaataatcgacctagtgacctacggtacggggtccgaaacgaacgtccgtaccggaaggggaacggggccgtaggggtaaggttcggggttcctaagtaaaggttggtttaaggtaggaaaccgtaggtacggtaaacctagtacgccgttagcgggaccggtacttcgtgggtaagggaaccgggtccgtaacttaccaaccgtactaccgtaccaagaacgaaaccgaaaccgaccgaacgacgtaccctcccttagtactacgtacgaactaaagtaacgaaacgtagtaccgtaggaacgacccgtagggaaacgtacccgtaccggttcctttacttaacgtttcgttacgtacggtaaaaccgtaaaacccggggtccccggttaagaccggtaccgtaacggtacggtaaccgtaaaggtttacggttttaccgg

SEQ ID NO: 339191 - DNA, 627 bp, Homo sapiens
  misc_feature: GZ8MTXP02ILTX5.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacgttggtagagcctggcaggtccctgagactctcctgtgcagcctcgtggattacaaatttaangaataatgaccatgcacgtgggtccacaagctccgaaggggaacggcctgggagtgggtctacgaaggtgttaggtcggaactggtaggtaaccagtacgcctagtgggacggtacctcgtggtaggaacggtcccgattccgacctatccaccgagacgaccaaacgccgaaagacgcctacccgtgtaactcctaggacctaaagtacgaaactgtaccgtagacgtacccgtaggaacggaccgtaccggtccctttattacgtttcacggttacgaaacgtaaaaccgggtccccggtaagtcgggtaccgtaaggtacggtacttaaggtacgttttccgg

SEQ ID NO: 339192 - DNA, 631 bp, Homo sapiens
  misc_feature: GZ8MTXP02H0BI3.38.53.E09.1.454.CMB.2.raw
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtggggganacttggtagagcctggcaggtccctgagactctcctgtgcagcctntggattacaaatttaangataatgaccatgcacgtgggtccgaacaacggcctacccggaaggggaacgggccgtagggaggttggggtcctactaaaggtggtttaaggtcgggaaaccaggttagggtaacccaagttacgacccttagtgaccgggtacttcgtgggtacggaaagggggccctaagttccacccaatccgtacccaaagacgaaccgaaaccgacccgaaagagccctacccgttgtactcgtgaactaaatagaactagtctagacgacctagagaccacggtccttctatttcgagtacgacgaaacggtccccgtaagtcggactaggtacgacgttaagcggttttacg

SEQ ID NO: 339193 - DNA, 680 bp, Homo sapiens
  misc_feature: GZ8MTXP02F0NEK.38.53.E09.1.454.CMB.2.raw
  modified_base (262)..(262): a, c, t, g, unknown or other
  misc_feature (262)..(262): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagacgttggtagagccgtggcgaggtccctgagactctcctgtgcngctcgtgattactaaatttaatgtaataagtcgaccatcgctacgtcgggtaccgaacaacggcctacccggaaggggaacggggtcccgtaggggtaggttcggggttactacggtaaggtttggtttaaggttacgggaaacgtaggttacgggtaacctagtacgaccgttagtcggacggtacgttccgtagggtagggtaaacggggccctagttcccaacctataccctacgaagaacgaaccgaaaccgacccaagacgtcctaccctgtactcgtacgaactaaagtacgaaacgtcggttactaggaacgacgtagggacgtacgtaccgttcctttatactttcgacggtacgaaaccgaaccggtacccgtaagtcgacgtaggtacgtacgtaaggttcgtttacg

SEQ ID NO: 339194 - DNA, 670 bp, Homo sapiens
  misc_feature: GZ8MTXP02HCTOM.38.53.E09.1.454.CMB.2.raw
  modified_base (216)..(216): a, c, t, g, unknown or other
  misc_feature (216)..(216): n is a, c, g, or t
  modified_base (277)..(277): a, c, t, g, unknown or other
  misc_feature (277)..(277): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttggtagagcctggcaggtccctgagactctcctgtgcagcctcgtgtatactaattangtaataatcgactagtcgaccgtacggttcgggaccgaaagacgtccgtaaccggaaggggtacggtcggtagggtagggtcggtcctagtaaggttgttaggtacggaactggtacgtactagtacgctaggtcgacgtactcgtggtacggaacgggtcgtactccactactcctacgaacgtacaaccgacgaacgaagaccgccttaccgtatactagtacgaacgtaagacaacggattcgacgtaacgtaccgtaagggaacggaccgtaccggttccttttaacgtacgtttcgtaacggtaacggtaacccgtaaaaacccggggttccgtaacggtacggtacggaaaggttacgaccggttaaaggtttaaccggttttccgg

SEQ ID NO: 339195 - DNA, 744 bp, Homo sapiens
  misc_feature: GZ8MTXP02GX4EV.38.53.E09.1.454.CMB.2.raw
  modified_base (216)..(216): a, c, t, g, unknown or other
  misc_feature (216)..(216): n is a, c, g, or t
  modified_base (277)..(277): a, c, t, g, unknown or other
  misc_feature (277)..(277): n is a, c, g, or t
tcagtcgatcacgtcacgaccggtgctcgatttagagagagtgtgttgggtttggggggagagaagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttggtagagcctggcaggtccctgagactctcctgtgcagcctctggattcaaatttangaataatgccatcgctacgtgggtaccgaacaacgctaccgaaggggaacgggcctagggagtggggtactacgtaaggttggtttaagttcgggaaactaggttacggtaacccagttacggacccttagtcggccgggtaaccttcgtcgggttaggggaaaacgggggtccccgtaagtttacccgaaccctaattacccgtacccgaaaggaaccgaaaccgaaaccgggaccccaaaagggaccgtaccccttacccccgttaggtaaaccttccgttaacggaacctaaaaagttcggaaaacctacggttctacggaacgtacccgtagggaaacggacccgtacgggttaccctttacgttaacgtttccgtaggtaccgtaaaaccgtaaaaccggggtccccggtaaggttacggaccggtaagtacggtacgttaaaacggttcggtttttaccgg

SEQ ID NO: 339196 - DNA, 549 bp, Homo sapiens
  misc_feature: GZ8MTXP02JLVU8.38.53.E09.1.454.CMB.2.raw
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagacttggtagagcctggcaggtccctgagactctcctgtgcagcctctggattcaaattatgataatgccatgcactggtccacagctcaggaaggcctgggagtgggtctcgaagtgtagtgaactagtgtacntagctatcgcgatctgtgaagggccgatcgaccatcnccagagacaacgccaagagcctcctgtacnctgacaaatgaacaggtctagacgacctgaagtacaacgggccctttntaacttttcgnggttacgaaaccgaaaacggggcccccggttaagtcgggacgtaacggtaaggtcctaaaaggtcggttttaccg

SEQ ID NO: 339197 - DNA, 552 bp, Homo sapiens
  misc_feature: GZ8MTXP02FIMHN.38.53.E09.1.454.CMB.2.raw
tcagtcgatcacgtcacgaccggtgctcgatttagagagagtgtgttgagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctcccctgtatctgcaaatgaacagtctgagacctgaggacacggccttctatttctgtgacaaaaggccccggtatggcagtagctaagagttcttgactcgtggggccaggggacccggtcaccgtctcctcagcctcccaccaacgggcccagtccggtaccttcccccgtggcccgccctcgcctccagggtacgccaacctccgacgacgcacacgccggcccgtggggctcgcctcggacaacggaccttacgttccaacgttcgactccgactggacgccgggg

SEQ ID NO: 339198 - DNA, 710 bp, Homo sapiens
  misc_feature: GZ8MTXP02FULSI.38.53.E09.1.454.CMB.2.raw
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagacttgggtagagcctggcaggtccctgagactctcctgtgcagcctctggattacaaatttaatgaataatcgccatgacacgtcgggtaccgaacaacgcctaccggaaggggaacggggtcccgtaggggacggtcggggttacctacgtaaggttggtttaaggttgggaaacctaggtacggtaaccagtacgccgtagtcggacggtacttcgtgtagggaagggtcgtaacttccaacctatccgtaccgaagacgaaccgtaaaccgaccaaaaggtacgcccttacccgttagtactccgttagaacctaaaagttacgaaacgtaggttccgtaaggaacggacccgtagggaaaccggacccgtaaccggttccctttactttaactttacggtacgttacggaaaaccgtaaaaccgggggtccccggttaagtcggggacctaaagggtacgtaacgttaaacgggttacggtttttaccg

SEQ ID NO: 339199 - DNA, 558 bp, Homo sapiens
  misc_feature: GZ8MTXP02I0JYG.38.53.E09.1.454.CMB.2.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagacttggtagagcctggcaggtccctgagactctcctgtgcagcctctgatcaaatttangatatgccatgccagtgggtccganaagcctaccgaggggaaggcctgggaggtggctgagtgttagtgaacngtggtaccatagcctgngcggactcgtggtagaacgggcctagttcaccatctccagagaccaacgccaagacgctacccgtgtactctgacaaagtgaacagtctgacgaccgtagaggaccaccggtcttacttacgtttctcgtacgtaaccgaaaaccgggtccccggtaagtcggactacggtagacgttaaggtacggttttacg

SEQ ID NO: 339200 - DNA, 707 bp, Homo sapiens
  misc_feature: GZ8MTXP02GTPBX.38.53.E09.1.454.CMB.2.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (397)..(397): a, c, t, g, unknown or other
  misc_feature (397)..(397): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacttggtagagcctggcaggtccctgagactctcctgtgcagcctntggattacaaatttaatgataatgccatgcacgtgggtccaacagctaccgaggggaacggcctgggagtggggtctacgtaagtcggttagttcggaacaggtgtaaccatacgcctagtcgcggtactcgtgnggaaacgggccctagttccaccgtatccgtacccaagaacgaccgaacgacccgaaacgacgtacccttcccgtaggttaacttcgttacgaacttaaaacgtaggaaaccctaggttaccctaggtaaaccgtacccggttagggaacgggtaacccgaaccggggttcccccttttagtttaaccgtttccggttaacggtttaccggaaaaccggttaaaacccgggggtacccccgggttaaggtcgggaacccgttaaggggttaacggtaaccggttaaaagggtttacggggtttttaaccgg

SEQ ID NO: 339201 - DNA, 614 bp, Homo sapiens
  misc_feature: GZ8MTXP02GIJGX.38.53.E09.1.454.CMB.2.raw
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (449)..(449): a, c, t, g, unknown or other
  misc_feature (449)..(449): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttggtagagcctggcaggtccctgagactctctgtgcagcctctggattacaaatttangaataatgccatgaccagtcgggtaccaacagctaccggaggggaacggcctgggagttgggtctagtagtgttagtagaactagtacgtacatacgctagtcgacgtactgtgtaggacgggcctattccgaacccataccacgaagacaacgaacgaccaaagcncctacctagtaactctagaacaaattacgaaactacggtaccgtagaacgacctagggaacgtaccgacgtttccctttaattacttaccgtggtaccgaaaccgtaaaccggggtccccgttaagcgtaaaccgaggttaccgtacgtaaggttacgttttacg

SEQ ID NO: 339202 - DNA, 567 bp, Homo sapiens
  misc_feature: GZ8MTXP02FK148.38.53.E09.1.454.CMB.2.raw
  modified_base (218)..(218): a, c, t, g, unknown or other
  misc_feature (218)..(218): n is a, c, g, or t
  modified_base (335)..(335): a, c, t, g, unknown or other
  misc_feature (335)..(335): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctgggtggagtcgtggggganacttggtagagcctggcaggtccctgagactctcctgtgcagccctctggattcaaatttaatgataatgccatgcactgggtccacaagctccaggggaggcctggagtgggtctnaagtgttagtggaacagtggtaccatagcctatgcgtactcgtgtagaacggggcctattccaacctatctaccagacgaaccaacgcccaaagacgcctaccctgtactcgtagacaaaatgaaaccagtctagacgacctgacggaccacggtccttgttaacttcgtagtacgaacaaaacgggtccccgtaagtacggccaaggtacgacgtaaggtacggttttacg

SEQ ID NO: 339203 - DNA, 655 bp, Homo sapiens
  misc_feature: GZ8MTXP02I4HFX.38.53.E09.1.454.CMB.2.raw
  modified_base (216)..(216): a, c, t, g, unknown or other
  misc_feature (216)..(216): n is a, c, g, or t
  modified_base (279)..(279): a, c, t, g, unknown or other
  misc_feature (279)..(279): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacgttggtagagcctggcaggtccctgagactctcctgtgcagcctctggattacaaatttangataatgaccatgacacgtgggtccgacaagcctaccgaaggggaacggccgtagggaggtgggtctacgaagttgttagttcggaactaggtcggtaccagtacgcctagtcgacggtactcgtaggtaggaaacggggccctaattaccaacctagttacctacccgaaagaacgaaccaaaccgacccaaagacgccttaccccgtagttaactccgttagacctaaaagttacgaaacctgttaccgtagaaacgtaccgtagggaacggaacctaaccgggttcctttacgttaacgtttcgtaggttacgaacgtaaaaccgggtcccgttaagtcgggactaggtacgacgttaaaggtcggttttccg

SEQ ID NO: 339204 - DNA, 825 bp, Homo sapiens
  misc_feature: GZ8MTXP02IM244.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagacttggtagagcctggcaggtccctgagactctcctgtgcagcctctggattacaaatttaangataatgaccatgactacgtcgggtccgaacaacgcctaccgaaggggaacgggccgtgggtacggtgggtctacgtaaggttggtttaggtttacgggaaacgtaggttacggtaacctagttaacggtcccttagtacggccggtaaccttccgttgggttacggggaaaccgggggtcccggtaaactttcccgaaacccctacgttacccctacccgaaaggaaaccgaaaccgaaaacccggaacccgaaaacgggaccggtaccccttacccccgttacgggttaacttcccgttaggaaaccctaaaagttaaccggaaacgtaaacggttacccgtaaggtaaccggtaaccccgttaggggaaccgggtaaacccgtacccggggttaccctttttaccgtttactttttaccggttaacggttacggaaaaccccggttaaaaacccgggggtcccccggttaaaggttacggggaacccggtaaggttaacggtaaccggtttaaaaggggtttaaccgggttttttacccgg

SEQ ID NO: 339205 - DNA, 613 bp, Homo sapiens
  misc_feature: GZ8MTXP02F9OF4.38.53.E09.1.454.CMB.2.raw
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (364)..(364): a, c, t, g, unknown or other
  misc_feature (364)..(364): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctgggtggagtcgtgggggagacttgggtagagcctggcaggtccctgagactctcctgtgcagccctntggattcaaatttaangataatgccatgcacgtgggtccaacaagctacccgaggggaacgggcctagggagtgggtctacgaagtgttagtcggaacngtagtaccagtacgctagtgcggactcgtgtagaaacgggcctagttccaccatacctaccaagaacgaccaaacgacccgaaagacgacctaccctagtactctagactaaagtacgaaacctagtactacgaacgaccgtagaacggaccaaccgggtcctttacttaacgtttccgtagttcgaaaccgtaaaaccgggtccccggtaagtcggactacggtagtacgttaaaggtacggtttacg

SEQ ID NO: 339206 - DNA, 782 bp, Homo sapiens
  misc_feature: GZ8MTXP02G61VJ.38.53.E09.1.454.CMB.2.raw
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
tcagtcgatcacgtcacgaccggtgctcgatttagagagagtgtgttgggtttgggggggagaggagccccagccctgagattcccaggtgtttccattcagtgatcagcactgaaccacagaggactcaccatggagttgggactgagctggtattttcctttggcttaattttaaaaggtgtccagtgtgaagtgcagctggtggagtcgtggggganacttggtagagccgtggcaggtccctgagactctcctgtgcagcctcgtggtattactaaatttaangataatcgaccatgaccacgtgggtaccgaacaacgtcctaccggaggggaacgggccgtagggtaggtcggggtctacgtaaggttggtttaggtacggaaactaggttacgggtaaccctagtaaccggtccttagtcgggaccggtaacttcgttagggtaacggggaaaccggggtcccgttaactttacccgaacccgttaacgttcccgtaacccgaaaggaaaccgaaacccgaaacccggaacccgtaaaacgggacccgttacccttaccccgttaggttaacctcccgtaagtaaccctaaaagtacgtaaaccgtacggtacgttacggaaaccggtaccgttaacgggaccggtaacccgtaacccggtttcccttttacgtttaccgttttacgacgggttaccgtaaacccggtaaaccgggttaccccggtaagtacgggacctaacgggtacgtaccgttaaacgggttacgttttccg

SEQ ID NO: 339207 - DNA, 844 bp, Homo sapiens
  misc_feature: GZ8MTXP02HN858.38.53.E09.1.454.CMB.2.raw
  modified_base (291)..(291): a, c, t, g, unknown or other
  misc_feature (291)..(291): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtcctagtgtgaagtgcagctggtggagtcgtgggggatacgttggtagagccgtggcaggtccctgagtacctctccgtgtgcagcctcgtggtattacaaattttaanagtaattaagtcgacctaagtcgacctaacggttcggggtacccgtaacgaaacggtcccgtaaccccggtaaagggggtaaaccggggtcccgtttagggggtaacgggttcgggggttaccttaaccggtaaagggtttggggttttaacgggttaccggggtaaaaccgtaggggttacgggtaaccctaaaggttaaccggtccgttacggtcgggtaccggttacgttaccggttgggttaaacgggggaaccggggtacccggtaacgttacccgtaaccctacgttacccgtacccgaaacggtaacgaaacccgaaccggaacccgaaacgaccgtacccgttacccgttacgttactaccgttacgtaactaaacgttacgtaaaccgtacgttacgtacgaaccggtaccgttacggaaaccgtaccggtaccgtttcccgtttacttacgttttacgtacggttacgaacccggtaaaaccgggttccccggtaagtccggaacgtacgggtaacgtaccggttaaggttacgttttaccgg

SEQ ID NO: 339208 - DNA, 597 bp, Homo sapiens
  misc_feature: GZ8MTXP02GR8YQ.38.53.E09.1.454.CMB.2.raw
  modified_base (218)..(218): a, c, t, g, unknown or other
  misc_feature (218)..(218): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (458)..(458): a, c, t, g, unknown or other
  misc_feature (458)..(458): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtggggganacttgggtagagcctggcaggtccctgagactctcctgtgcagcctctggattcaaatttaatgataatgaccatgcactcgggtccaacaagcctccgaaggggaacgggcctgggaggtggtctacgaagtcgttaagtcggaaacnggtgtaccatacgccttagcgacggtactcgttgnggaaacggggcctattcaccatctccagacgacaaacgccaaagctcctaccgttnactcgacgaacaaagtagaactgtacgagaacgtacgaggacgaccgtacgtcctttacttacgtttcgtacgtaccgaaccgtaaacccgggttcccgtaagtacggacgtaacggtagtacgtaaggttcgtttacg

SEQ ID NO: 339209 - DNA, 845 bp, Homo sapiens
  misc_feature: GZ8MTXP02JE81J.38.53.E09.1.454.CMB.2.raw
  modified_base (220)..(220): a, c, t, g, unknown or other
  misc_feature (220)..(220): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtggggganacgttgggtagagccgtggcacggtccctgacgctctcctgtgcagcctntggattacaaatttangataatcgacctatcgacctacggttcgggtacccgaacgtaacggcccgtaaccggaagggggtaaacgggtccggtaggggtacgggttcggggtacctaacgtaaagggttcggttttaaggtaccgggaaacgtacgggttacggtaaaccctaggttaacgtacccgtttagtcgggtaccgggtaaacttccggtaggggttaacggggaaacgggggtcccttaaactttacccggaaaccctacgtcccgttaaccgaaaggaaccgaaaacccgaaaccggacccgaaaagggtacccgccctttacccgtaggtttaacctccgttaaggaaacccttaaaagggttaccgaaaacgttacggttaccgtacgggaaaacgtacccggttaaggggaaaccggtaacccgttaacccgggtttcccttttaacgtttaacgtttcggtaaacggtttaccggaaaacccgggtaaaacccggggtccccgttaaggtaccccgaacggttaaaggtacgtaaccggtttaaaggttaccggttttcccg

SEQ ID NO: 339210 - DNA, 671 bp, Homo sapiens
  misc_feature: GZ8MTXP02JV6CF.38.53.E09.1.454.CMB.2.raw
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctgggcaggtccctgagactctcctgtgcagcctnggattcaaatttangataatgccatgcacgtgggtccgaacaagcctaccgaaggggaacggcctgggagtgggtctacgaaggtgttaggtcggaacaggtggtaccagtcgccgtatcgggacgtacttcgtaggtacggaaacgggggcccgtaatttcccgaaacctacttcctacccgaaggacgaaccaaaccgacccgaaaggacgacccttaccccgtagtaaccttcgacgaccaaaagttacgaaacaggttccgaggacgacccgtaggaaccgggtaacctaccgggttacccctttagtacttttcggacgttacgaaccgtaaaaccgggggtacccccggttaagtccgggacgtaagggtacgtaccggttaaaggtacggtttttccgg

SEQ ID NO: 339211 - DNA, 642 bp, Homo sapiens
  misc_feature: GZ8MTXP02JXDUW.38.53.E09.1.454.CMB.2.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (558)..(558): a, c, t, g, unknown or other
  misc_feature (558)..(558): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtncagctggtggagtcgtggggganacgttggtagagccgtggcaggtccctgacgactctcctgtcgcacgtcctcgtggtacttacaaatttangaataatcgacctaagtgacctacgttcgggacccaactaacgccctacggaaggggaacggccgtgggacggttggggtcctacgtaaggttcggtttaaggttacggaactaggtacggtaccaagtacgactagtcggcggtactcgtggtagggaaccggcgtacttacaacctgtcctaccaaaggaccgaaccaacgaaccgaagaccgtccctcccgtatacgtactcgaactaaagtcgaaactacgtcgtagacgtaccnggaaacgcgtacgtcttatacttcgtgtacgaacgtaaacccggtccgtaagtcgaacgtagtagtactaaacggttcgtttcg

SEQ ID NO: 339212 - DNA, 669 bp, Homo sapiens
  misc_feature: GZ8MTXP02HEIHP.38.53.E09.1.454.CMB.2.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggganacttggtagagcctggcaggtccctgagactctcctgtgcagcctctggattcaaatttaaangataangaccatgcacgtggacgacaagctacgaggggaacggccgtaggaggtggtctacgtaagtgttagtacggaactagtagtaaccatacgctagtcggacggtaccttcgtgtaggaaacggggccctaattccaaccctatccaccaagacgaacaaacgaccaaagtacgcctaccctagttaactcgtagaacgtaaaacgtaaacgtaaaccgtaacgtacgtacgaacggtaaccgtacggaaacggaaccgtaacccggtacccgtttacctttaacgtttacgttacgtacgtaaaccggtaaaaccgggtaaaccccggtaaccggttacggtacgtaacggtaacggtaaccggttaaacggttaacggtttacgg

SEQ ID NO: 339213 - DNA, 640 bp, Homo sapiens
  misc_feature: GZ8MTXP02GZKQR.38.53.E09.1.454.CMB.2.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttgggtagagcctggcaggtccctgagactctcctgtgcagcctcnggattacaaattangataatgccatgcacgtcggtccgacaagctaccgaggggacggccgtggaggtgggtctacgaaggtggttaggtcggaactaggtacggtaccagtacgcctagtcgcggtactcgtgtagagggcctattcgacctatcctcagacgacacgcaagcgcctaccgtgtactcgtagactaaatacgaaactaggtacctaggaaccgtacccgttagggaacggtaacccgtacgggttacccctttactttaaaccgtttcgttacggtaccgtaaaaccggtaaaacccggggtacccccgttaaggtaccggtaccgtaaggtaacgtaccgtttaaagggtacgtttttacccgg

SEQ ID NO: 339214 - DNA, 715 bp, Homo sapiens
  misc_feature: GZ8MTXP02HDI4D.38.53.E09.1.454.CMB.2.raw
  modified_base (217)..(217): a, c, t, g, unknown or other
  misc_feature (217)..(217): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggganacttgggtagagcctggcaggtccctgagactctcctgtgcagcctctggattcaaaattttaaangaataangaccatgcacgtgggaccaacaacgcctaccggaaggggacggccgtagggaggtgggtctacgtaaggttggttaggtacggaacaggtacggaacctagtacgctagtcggacggtaccttgtaggtaggaaacggggtccctattacccaacctatccctaccgaaaggaacgaaaccgaaaccggaacccaaaaggaccgacccttacccgttagttaactcgtagaactaaaagtacgaaacgtaacgtacgtacgtaacggtaccgtaacggaacgggtaaccggtaacccggtacccgtttaccgtttaacgtttacgttacggttacggtaaaccggtaaaaccgggtaaaccccgggttaaccggtacggtacggtaacggtaacggtaaccggttaaacggttaacggtttaacg

SEQ ID NO: 339215 - DNA, 701 bp, Homo sapiens
  misc_feature: GZ8MTXP02JWG3Y.38.53.E09.1.454.CMB.2.raw
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttcctttggctattttaaaggtgtccagtgtgaagtgcagctggtggagtctggggganacttggtagagcctggcaggtccctgagactctcctgtgcagcctntggattcaaatttangataatgccatgcacgtgggtccacaagctaccgaggggaacggcctgggagtgggctcgaagtgttagtcggacngtggtaccngtacgcctagtcgcggtactcgtggtagaaacgggtcccgaatttcccgaaaccctagttacctacccgaagaacgaaacccgaaaccggaccccgtaaaaggaccgtacccttaacccccgttggtaaaccttctacggaaccaaaagttcggaaaaccctaggttaccgtaggaacgtacccgttagggaaacggggaaccctaaccggggttccctttacggttaaaccgtttttccgtaggggttaaccgaaacccggtaaaaaccggggtcccccggtttaagaccggggtaacctagggttaaccgtacgttaaaacggtacggggtttttaacccg

SEQ ID NO: 339216 - DNA, 698 bp, Homo sapiens
  misc_feature: GZ8MTXP02ILS5X.38.53.E09.1.454.CMB.2.raw
  modified_base (266)..(266): a, c, t, g, unknown or other
  misc_feature (266)..(266): n is a, c, g, or t
  modified_base (551)..(551): a, c, t, g, unknown or other
  misc_feature (551)..(551): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagacgttgggtagagcctggcaggtccctgagactctcctgtgcagcctntggtattactaaatttaatgtaataaatcgaccctagtcgaccgtacggttcgggtacccgaacgaacggtcccgtacccggaaggggtaaacgggtccggtaggggtacggttcggggtccttaccggaaaggtttggtttaaggttacggaaacgtaggttacggtaacctaagttacgtaccttagtcgacggtacgttcgtgggtaggaacgggtcctagttcacctatcctacaagacaacgaaccgacaaagcgacctcctagtactctagactaaganactagactgaacgtacctaggaacgaccgtaccggttacctttacgttacgtttacgacggttaccgaaaaccggttaaacccgggtaccccggttaagccggtaacgtaggttaacgtaccgttaaaagggtttcgttttaaccgg

SEQ ID NO: 339217 - DNA, 881 bp, Homo sapiens
  misc_feature: GZ8MTXP02F5TM9.38.53.E09.1.454.CMB.2.raw
  modified_base (288)..(288): a, c, t, g, unknown or other
  misc_feature (288)..(288): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagcgtggtggagtcgtgggggagtacgttggtagagccgtggcaggtcctgagactctcctgtgcacgcctcgtggtattactaaatttaangtaataagtcgacctatcgccacggtcgggtaccgaacaacgtccgtaccggaaggggtaacgggtccgtggggaggtcggggttactacgtaaggttggtttaggttacgggaaacctaggttacggtaaccctaagttaccggtaccttaggtcgggtaccgggtaacctttccggttaggggtaacggggtaaaaccgggggtccctttaaacgtttacccgaaacccccttaacgttacccccgttaaacccgaaaacgggtaaaacccggaaaaccccgaaaaccccggggaaacccgaaaacgggtaaacccggttccccctttaaccccgttaggttaaacccttccgttaacgaaaacctaaaagttaccgaaaaccgtacggtttacgtacgggaaaacggtacccgttaagggaaacccgggtaaaccgttacccgggttacccctttttagtttaaaccgtttttcggaacgggttaaccggaaaaaccccggtaaaacccgggggttaccccgttaaggttaccgggaaaccgtaaggtttaaaccgaaccggtttaaaagggttccggttttttaaccgg

SEQ ID NO: 339218 - DNA, 659 bp, Homo sapiens
  misc_feature: GZ8MTXP02J1T33.38.53.E09.1.454.CMB.2.raw
  modified_base (216)..(216): a, c, t, g, unknown or other
  misc_feature (216)..(216): n is a, c, g, or t
  modified_base (279)..(279): a, c, t, g, unknown or other
  misc_feature (279)..(279): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacgttgggtagagcctggcaggtccctgagactctcctgtgcagcctctggattcaaatttangataatgccatgcacgtggtccacaagctaccgagggacggcctagggaggtggctacgaaggttggttaggttaggaacctaggtacgggtaaccctagtaacgtcctagtggaccgggtactcgtggttacggaaacggggtcccgtaactttccgaaccctagtacccttacccgaagacgaaccgaacgacccgaaagcgaccttccccgtagttactccgtagacctaaagtagaacagttcagacgtaccgagacggacctaccgggtccttacgttacgtttacgtacggttacgaacccgtaaaaccgggtcccccggttaagttaccggggacctaagggttacgaccgttaaggttaacggtttttccgg

SEQ ID NO: 339219 - DNA, 673 bp, Homo sapiens
  misc_feature: GZ8MTXP02IDHP8.38.53.E09.1.454.CMB.2.raw
  modified_base (287)..(287): a, c, t, g, unknown or other
  misc_feature (287)..(287): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagacgttgggtagagccgtggcaggtccctgagctctcctgtgcagcctcgtggtattacgtaaatttaangaataatcgccatgactacgtcgggtaccgaacaagccgtaccggaaggggaacgggtccgtagggaggtcgggtctacgaaggttggttaaggtacggaaactaggtacgtaacctagtacgacctagtcggacgtactcgtagtagggaacgggtacccgtattaccgacctactccgtaccgaagacgaaccgaaaccgaccgaaagacgtcctacccgtgtactacgtacgaactaaagtacgaaacgtacgtaccgtagaacgtaccgtaggaaacgaaccgtaccggtactttacgttaacttcgtacgtacgtaaaccgtaaaaccgggtccccgtaaggtcggtacgaggtaacgtacgtaaaggttacgtttaccgg

SEQ ID NO: 339220 - DNA, 562 bp, Homo sapiens
  misc_feature: GZ8MTXP02JL4MO.38.53.E09.1.454.CMB.2.raw
  modified_base (191)..(191): a, c, t, g, unknown or other
  misc_feature (191)..(191): n is a, c, g, or t
  modified_base (229)..(229): a, c, t, g, unknown or other
  misc_feature (229)..(229): n is a, c, g, or t
  modified_base (290)..(290): a, c, t, g, unknown or other
  misc_feature (290)..(290): n is a, c, g, or t
tcagtcgatcacgtcacgaccggtgctcgatttagagagagtgtgttgggtttgggggaaggaggaagactgacggtcctgccacaggtggtgctgggcacggtgggcactcgacacaacattgcgctcaactgtcttgtctcaccatggagttgggactgagctggattttcctttggctatttaaaggngtccagtgtgaagtgcagctggtggagtcgtggggganacttggtagagcctggcaggtccctgagactctcctgtgcagcctctggattcaaatttangataatgccatgcacgtgggtccagaacgctaccgaggggaacggccgtgggagtcggggtctacgagttgttagtggaactggtgaccagtacgcctatgcgactcgtgtgtaacgggcgattcaccatctaccgagtacacaacgcaaagcgacctcccgtagtactcctagacaatcgaactagtctacgacgtaccaggacgacgtacggtaccttcttaacgttccgtagtcgtaaaccgaaacggtcccccggtaagtcggaacgg

SEQ ID NO: 339221 - DNA, 616 bp, Homo sapiens
  misc_feature: GZ8MTXP02G77WV.38.53.E09.1.454.CMB.2.raw
  modified_base (218)..(218): a, c, t, g, unknown or other
  misc_feature (218)..(218): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggcttaattttaaaaggtgtccagtgtgaagtgcagctggtggagtcgtggggganacgttgggtagagccgtggcaggtccctgagactctcctgtgcagcctctggtattactaaatttaatgaataatcgacctatcgactacggtcgggtaccgaacaacgtccgtaccggaaggggaacggccgtagggaggtcgggtactacgtaaggttggtttaggtacggaacgtaggtacgtaccagtacgctagtcgacggtactcgtggtagggaacggtccgtacttaccacctatccacgaacgacgaaccgaacgaccgaaacgctccgtaccctagtaacctcgtaagactaacgtagaactgtactagacgtacgagacgactacgtcgtccttactcttcgtacgtacgaacgtaacggccgtagcgacagacgtacgtagttacg

SEQ ID NO: 339222 - DNA, 637 bp, Homo sapiens
  misc_feature: GZ8MTXP02FZPEH.38.53.E09.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
tcagtcgatcacgtcacgaccggtgctcgatttagagagagtgtgttggggtttggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggagacgttggtagagcctggcaggtccctgagactctcctgtgcagcctntggattcaaatttangataatgccatgcacgtggtccanaagctccgaggggaggcctgggagtgggtctgaaggttgtaggttcgaaacnggtacggtaaccagttaccgccttagtcggacggtacttcgtgggtaggaaacggggccgtattccgacccactcctacccaagacgaaccgaaaccgacccgaaacgacgccttacccctaggttactcgtacggaccaaaatacgaaactagtacgtagaacgaccgtaggaacggaccgaccggtacttacttacgtttcgtacggtacgaaaccgtaaacgggtaccccggttaagtacggaccgtaaggtacgaacgttaaggtacggttttaccg

SEQ ID NO: 339223 - DNA, 731 bp, Homo sapiens
  misc_feature: GZ8MTXP02JHK6O.38.53.E09.1.454.CMB.2.raw
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggtattttccttttggctattttaaaaggtgtccagtgtagaagtgcagcgtggtggagtcgtgggggagacgttgggtagagccgtggcaggtccctgagactctcctgtgcacgcctcgtggattacaaatttaatgaataatgaccatgacacgtcgggtccacaacgcctaccggaaggggaacgggtccgtaggggtacggttcggggttacctagtaaggttaggtttacggttacgggaaacgtagggttacggtaaccagtacgtacctagtcgaccggtacttcgtggtaggaaacgggccctagttccaacctatccgtacaagacgaaccaaaccgaccgaaagacgtccctacccgttgtactccgtagaactaaacgttacgaaacgtacggtacgtacggaaaccgtaccgacgggaacggtaaaccccgtaccggttaccccttttacgttaacgtttccgtaacggtaccgtaaaacccggtaaaaccccggggtccccggttaaagtacccgggaacgtaaacgggttaacgtaccggtttaaacggggtacgtttttaccgg

SEQ ID NO: 339224 - DNA, 776 bp, Homo sapiens
  misc_feature: GZ8MTXP02HOOL7.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacgttggtagagcctggcaggtccctgagactctcctgtgcagcctcgtggattacaaatttaangaataatgccatgctaacgtgggtccgacaagccgtaccgaaggggaacgggccgtagggaggtgggtctacgtaaggttggtttaagttgggaaactaggtacggtaccagtacggcctagtcgcggtaacgtccgttagggtacggaaacggggtcccaagtttaccaacccgtattaccgtacccaaggtaacgaaccgaaaaccgacccgaaaaggaccgtcccgttaccccgtaggttaactaccgttacggaacctaaaagttacgaaaacccgtagtaaccgttacggaaacggtacccgttagggaaacgggtaaaccccgtaaccggggttcccttttaaccgttaacgtttttacccggtaaggttaccgggaaaaacccgttaaaaacccgggggtccccccgggtttaaaaggtccgggtaacccgtaaaacggggttacgtaaaaccggtttaacggggttttaaaacggttttaccccggg

SEQ ID NO: 339225 - DNA, 750 bp, Homo sapiens
  misc_feature: GZ8MTXP02F35VA.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctgggtggagtcgtgggggagacgttgggtagagcctggcaggtccctgagactctcctgtgcagcctctggattcaaatttaangataatgacctatgcacgtgggtaccgacaaggcctaccggaaggggaacggggcccgtaggggaggtggggttcctacggaaaggttggtttaagggttacgggaaaactagggttacgggtaacccaagttaacggccctaggttcgggccggggtaaccttccggttggtacggggaaaacgggggtcccgtaagtttcccaacccgtaacttcccgttacccgaagggaaacgaaacccgaaaaccggaccccgaaaaggaaaccggccctttacccccggtaggttaacttacccgttacggaacctaaaagttacggaaaacgtacggttacctaggggaacgtacccgtagggacgggtaaaccgtaccgggtccctttacgttactttccgtagtaccgtaacgtaaaaccgggtccccggtaagtcgggactaggtacgacgtaaggttacggtttacgg

SEQ ID NO: 339226 - DNA, 589 bp, Homo sapiens
  misc_feature: GZ8MTXP02GAPJG.38.53.E09.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (334)..(334): a, c, t, g, unknown or other
  misc_feature (334)..(334): n is a, c, g, or t
  modified_base (522)..(522): a, c, t, g, unknown or other
  misc_feature (522)..(522): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccaggggaagggcctggagtgggtctcaagtgttagttggaacaggtggtaccatagcctatgcggactctgtgaagggccattcaccatccncaganacaacgccaagagctccctgtactctgacaaaatgaacagtctagacgacctggacggaacacggtcctttctagtttctggtnacgaaaaggccccggtatcggcagtagactaagtacggttctttgactcgtcggggaccgacggggaacccgggtcaccggtctcctacgacgccctccaaccgacggcccacgttccgtccctccccgtcggcccgccctcgccctcgacggaccgcacccgtcgacgacgcacgacggccgtccgnggctcgccgtggtaccgacggtacctaccgttacccgaacgtcgaactcgacgtacgacggcgtcgg

SEQ ID NO: 339227 - DNA, 750 bp, Homo sapiens
  misc_feature: GZ8MTXP02GPVD2.38.53.E09.1.454.CMB.2.raw
  modified_base (308)..(308): a, c, t, g, unknown or other
  misc_feature (308)..(308): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggaatcaccatggagttgggactgagctggtattttccttttggctaattttaaaaggtgtccagtgtgaagtgcagctggtggagtcgtgggggagacgttgggtagagccgtggcgacggtcccctggaacgtacctctcctggtcgcacgtcctcgtggtaattactaaatttaatgaattaangaccatgccacgtcgggtcccgaacaacgcctaccggaggggaacggtccgtgggaggttgggtctagtaaggttgtttaggtacggtaacgtaggtacgtaaccatacgcctagtcggacggtactcgtagggtacggaacggggtcctaattccgaaccctagtcccgtaacgaacgtaacgaacccaaaccggaccctaaaacggaccgtcccttacccgttggttaaccttacgtacgtaaacaaaacgtttacgaaaaccgtacggttacgttacggaaacggaacccgttaggggaaaccgtaaccgtaccggttacccttttacttaacgttttaccgtggttaacccgaaaacccggtaaaaccggtcccccgggtaagttaccgggacttaagggtaaccgtaaccggttaaaacggttcggtttttaacccg

SEQ ID NO: 339228 - DNA, 605 bp, Homo sapiens
  misc_feature: GZ8MTXP02HF548.38.53.E09.1.454.CMB.2.raw
  modified_base (280)..(280): a, c, t, g, unknown or other
  misc_feature (280)..(280): n is a, c, g, or t
  modified_base (498)..(498): a, c, t, g, unknown or other
  misc_feature (498)..(498): n is a, c, g, or t
  modified_base (556)..(556): a, c, t, g, unknown or other
  misc_feature (556)..(556): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctatttaaaggtgtccagtgtgaagtgcagctggtggagtcgtgggggatacgttgggtagagcctggcaggtccctgagactctcctgtgcagcctctggtattactaaatttaangaataatgcccatcgaccacgttcgggtacccaacgaacgcgtacccgaagggggaacgggccgtagggtaggtcgggttctacgtaaaggttggttaaggttacggaaactaggtcggtaaccagtacgtcctagtcgcggacttcgtgtaggaaacggggtcctagttccaaccgatcctacgaagacgtacaacggcaaggctcctcctgtaacnctagactaaagtgaaactgtcagagaccgtagaacggcacggtcctttatacgttcgngtacgaacgtaaccgtccgaagtcggactaggtactacgtagttcgttc

SEQ ID NO: 339229 - DNA, 638 bp, Homo sapiens
  misc_feature: GZ8MTXP02IKUYU.38.53.E09.1.454.CMB.2.raw
  modified_base (366)..(366): a, c, t, g, unknown or other
  misc_feature (366)..(366): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctctgtgcagcctctggattacaaatttaatgaataatgccatcgacacgtgggtaccgacaagcctaccgaggggaagggcctgggacggtgggtctacaggtgttaggtaggaacngtcggtaccatacgcctagtgcgggtactcgtggtggaaacggggtccgacgttacaccctactccgtaccaagaacgaaccgaaacggacccaaagacgcctaccccgttagtaactctcgacaaacttaggaaactacggtctaggacgaccgtaggaacggaccaaccgggtccttacgttacttttacgcggtacgaaccgaaaaccggggtccccggtaagttaccggggactaaggtacgacgttaaacgggtacggtttttaccg

SEQ ID NO: 339230 - DNA, 661 bp, Homo sapiens
  misc_feature: GZ8MTXP02HPFHV.38.53.E09.1.454.CMB.2.raw
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagacttgggtagagcctggcaggtccctgagactctcctgtgcagcctctggattacaaattttangataatcgaccatgacacgtcgggtaccgaacaagccgtaccggaaggggaacggggccttagggacggtggggtctacgaaggttggtttaagtcgggaaactaggttcggtaaccagtacgcctagtggcggactcgtggtaggaaacgggcccgtattccgaaccctatcctaccgaagaacgaaccgaaacgacccgtaaagaccgtccttaccccgtagttactcttaggaaccaaaagttcgaaaacctggtacctaggacgaccgtaggaaccggaacctaaccggtcctttacgttacttccgtaggtacgaaccggtaaaaccgggtcccgtaagtcggactaaggtacgtacgtaaggttacgttttccg

SEQ ID NO: 339231 - DNA, 802 bp, Homo sapiens
  misc_feature: GZ8MTXP02GRFIK.38.53.E09.1.454.CMB.2.raw
  modified_base (293)..(293): a, c, t, g, unknown or other
  misc_feature (293)..(293): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggagacgttgggtagagccgtggcacggtccctgagacctctcctgtacgcacgcctcgtggtattactaaatttanagataatgaccagtcgcctacggtcgggtaccgaacgaaacggtccgtaccggaagggggtaaccgggtcccggttaggggtaacggtttcggggttaccgttaacgtaaaggggtttaggtttttaacggttaccggggtaaaaccgtagggttaccgggtaaaccgtagttaaccggcccttaggtcgggtaccggggtacctttaccggtagggttaacgggaaccgggggttacccttaaacgtttcccaaacccgttaacgtttcccgtaaccccggaaaaggtaaaccggtaaccccgaaaacggttaacccccgaaaagggtccctcccgttaccccgtttaggtaaacccttcggttaacgaaacctaaaaggttacgaaaacgttacgtaccgtaggaaacgtacccgtgggaaaccgacgtacggtccttacgtttacttccgtaggtacgacgtaaaccggtccgaagtcgactacgagtaccgtaagttcgtttacg

SEQ ID NO: 339232 - DNA, 637 bp, Homo sapiens
  misc_feature: GZ8MTXP02I3JDF.38.53.E09.1.454.CMB.2.raw
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (277)..(278): a, c, t, g, unknown or other
  misc_feature (277)..(278): n is a, c, g, or t
  modified_base (282)..(282): a, c, t, g, unknown or other
  misc_feature (282)..(282): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggctattttaaaaggtgtcagtgtgaagtgcagctggtggagtcgtggggganacgttggtagagcctggcaggtcctgagctctcctgtgcancctntgattacaaatttannatangcatgcacgtggccacagcaccgagggaacggccgtgggaggtcgggtctagtaagtggtttagtacgaagtagtaggtaacctatacgccttagtcgacggacttcgtggtaggaaacgggtctattcaccatcacgagaacgacaaccgacaaagcgcctacctagtacctcgtagaaccaaagtacgaaactcgtactcggaacgtacccgtaggaacggaccgtaaccggttccctttacttacgttttaccgtaggttaacggaaaacccgtaaaaccggggttccccgtaaggttcccggaacgttaacgggtacgttaacggttaaaacgggttaacggtttttcccg

SEQ ID NO: 339233 - DNA, 736 bp, Homo sapiens
  misc_feature: GZ8MTXP02HR2FM.38.53.E09.1.454.CMB.2.raw
  modified_base (280)..(280): a, c, t, g, unknown or other
  misc_feature (280)..(280): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaggtgtccagtgtgaagtgcagctggtggagtcgtgggggagacgttggtagagcctgggcaggtccctgagactctcctgtgcagcctctggattcaaatttangataatcgcctatcgctacgtcggggtacccaacaacgcctaccggaagggggaacgggtccgtaggggtaggtggggttctacgtaaagggtttcggtttaaggttcgggaaacgtagggttcggtaacctagtacggcctagtcggcggtacttcgtaggtacgggaaacgggtcccgtaacgtttccaccctatcctacccgaagacgaaaccgaaaccggcccaaaaggtaccgtacccctcccgttacggttactccgttacgaacgtaaaacgtacggaaaactcggttaccgtaaggacgttaacccgtggaaacgggacccgtaaccgggtttccctttacgtttaactttcgtacggttaccgaaccgtaaaaaccggggtcccccggttaagttaccgggaagttacggtaaccggtacggttaaaaggtttcggtttttacccgg

SEQ ID NO: 339234 - DNA, 600 bp, Homo sapiens
  misc_feature: GZ8MTXP02GCSZM.38.53.E09.1.454.CMB.2.raw
  modified_base (216)..(216): a, c, t, g, unknown or other
  misc_feature (216)..(216): n is a, c, g, or t
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
tcagtcgatcacgtcacgaccggtgctcgatttagagagagtgtgttgggtttggggggagaggagccccagccctgagattcccaggtctttccattcagtgatcagcactgaacacagaggactcaccatggagttgggactgagctggattttcctttggctattttaaaaggtgtccagtgtgaagtgcagctgggtggagtcgtggggganacgttggtagagcctggcaggtccctgagactctcctgtgcagcctntggattactaaattangataatcgaccatgacacgtggtccanaagcctaccgagggaacggcctggagtggtctanagtgttagtgaacnggtacgtacatacgctagtcgcggtactcgngtagaacggcgatcacagtctaccagacacaacgacctaaggacncctaccgtatattcctagacctaaatacgaaacctgtactacggaacgtccctaagggacgaccgtacggtcctttacttacgtttccttaggaccgtaaacgaaaaccggtacccccggtaagttacggaccgtaaaggtacgtaccgtaaaggttacggtttttccgg

SEQ ID NO: 339235 - DNA, 758 bp, Homo sapiens
  misc_feature: GZ8MTXP02GUV9G.38.53.E09.1.454.CMB.2.raw
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtggggganacgttggtagagcctggcaggtccctgagactctcctgttcagcctntggattcaaatttangataatgccatgcacgtggtaccanaagctaccgaaggggaacggtcctaggagtgggtctacgtaaggtgttaaggttacggaaactaggttcgggtaacctaagtacgacccttaagtcgggtaccgggaacttcgtaggtaggggaaacggggtccctaattcccgaacctattacccgaccaaggaaacggaaacccaaacggaccccgtaaaagggaaccgtcccttacccccgttaggttaaccttaccgtaacggaaccctaaaaaggttacgaaaaccgtacggtttaaccgtaacgggaacgtaaacccgttagggaaaccgggtaaccctaacccggggtccctttacggttaaactttttccggtacggttaacggaaacccggtaaaaaccggtcccccgggtttaaaagtcggggaacctaagggtaacgtaccggttaaaaggttcgggttttacctttaaccgggg

SEQ ID NO: 339236 - DNA, 570 bp, Homo sapiens
  misc_feature: GZ8MTXP02FV3N7.38.53.E09.1.454.CMB.2.raw
  modified_base (329)..(329): a, c, t, g, unknown or other
  misc_feature (329)..(329): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttcctttggctattttaaaggtgtccagtgtgaagtgcagctggtggagtctgggggagacttggtagagcctggcaggtccctgagactctcctgtgcagcctctggattcaaatttaatgataatgccatgcactggtccgacaagctccgagggaacggcctggagtgggtcncaagtgttagttcggaactagtggtaccatagcctatgcggatctgtgaagggccattcaccatctcccagacgacaaacgccaaagagacctccctgtactcgtgactaaaagtacgaaaccagtacctaggacgacctagacggacaaccggtccttactactttcctgttcgaacctaaaacgggcccccggtaagttcggacgtaacggtacgtaccgtaaaaggtacggttttccg

SEQ ID NO: 339237 - DNA, 660 bp, Homo sapiens
  misc_feature: GZ8MTXP02IKDZB.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagacgttggtagagcctggcacggtccctgagtactctcctgtgcacgcctcgtggtattactaaatttaagtgtaataatcgacctagtcgacgtacggtcgggtaccgaacgaagtcccgtaccggaaggggaacggccgtagggtacggttgggtactacgtaaggttagtttacggtacggtaaacgtggttacgtaacctagtacgaccttagtcgacggtaccttcgtgggtacggaacgggtcctaattccgaacctactcctacgaacgaacgaccgaaacgcaaacgactccctacgtagtactcgtacgaataaagtacgaacgagttacgtacgaacgtcgtaacgacgtaccgtacgttctttacgttctttcgacgtcgaaaaccgtacgaccgtaagtcgacgtagtacgacgttaacgttcgtttaacg

SEQ ID NO: 339238 - DNA, 518 bp, Homo sapiens
  misc_feature: GZ8MTXP02GGQW2.38.53.E09.1.454.CMB.2.raw
  modified_base (214)..(214): a, c, t, g, unknown or other
  misc_feature (214)..(214): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (433)..(434): a, c, t, g, unknown or other
  misc_feature (433)..(434): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (445)..(446): a, c, t, g, unknown or other
  misc_feature (445)..(446): n is a, c, g, or t
  modified_base (471)..(471): a, c, t, g, unknown or other
  misc_feature (471)..(471): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctggggganacttgggtagagcctggcaggtcccctgagctctcctgtgcagcccttggattcaaatttaangataactgcatgnactggtccgacaaagcncccgaggaagggccgtggagtgggtcgtcaagtgttagttggaacgagtggtaccatagctagtgcggactgtgtgaagggcggaattcaccatcnccaganacaacaccaagagcnccctntatnnanaananananngagacgagagacgacgtctctattntgtacgacgaacggaccgtaagtgacgagtagtacgtaagtagttcg

SEQ ID NO: 339239 - DNA, 592 bp, Homo sapiens
  misc_feature: GZ8MTXP02IW7WB.38.53.E09.1.454.CMB.2.raw
  modified_base (215)..(215): a, c, t, g, unknown or other
  misc_feature (215)..(215): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
  modified_base (531)..(531): a, c, t, g, unknown or other
  misc_feature (531)..(531): n is a, c, g, or t
tcagtcgatcacgtcacgaccggtgctcgatttagagagagtgtgttgggtttggggggagaggagcccagccctgagattcccaggtgtttccattcagtgatcagcactgaacacagaggactcaccatggagttgggactgagctggtattttccttttggctattttaaaggtgtccagtgtgaagtgcagctggtggagtcgtggggganacgttggtagagcctggcaggtccctgagactctcctgtgcagctctggattacaaatttangataatgccatgcacgtggccanagctccgagggaggcctggagtggtctntaagtgttagtgaacngtggaccntacgcctagtgcggtactcgtgaggaaacgggcctaagttcacccgtatctaccaaganaccaacgacctaaagcgaccttccgtagttataccgtgaaccaaacgtagaaaacccgtgttaccgtaggaaaccgtccgttagaacggaaccctacgggtcctttacgttactttccgngttacgaaccgtaaaacggtcccgtaagcgtactaacgtagacgttaaagtcgttttaacg

SEQ ID NO: 339240 - DNA, 679 bp, Homo sapiens
  misc_feature: GZ8MTXP02FQS0O.38.53.E09.1.454.CMB.2.raw
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
  modified_base (588)..(588): a, c, t, g, unknown or other
  misc_feature (588)..(588): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaattttaaaaggtntccagtgtgaagtgcagcgtggtggagtcgtggggganacgttggtagagcctggcacggtccctgagactctcctgtgcagcctctggtattacaaatttangaataatcgaccagtcgacacgttcgggaccaacgaacgtccgtacccggaagggggtaacgggtcccgtaggggtacggttcggggttacctaggtaaggtttaggtttaacggttagggaaaccgtagggttacgggtaaccctaagtaccggtaccgttagtcgggtacgggtaaccttcgttaggggtaacgggaaaccgggggtcccttaaatttacccaaccctagtaccctaccgaagaaccgaaccgtaacgaccgtaaagaccgcttacccgtagtctcagaacaagtcgaaacngtcagacgaccgtagacgtacacgtccttatacttcgcgtacgaaccgaacggtcctaagcgacgtagtacgtacgtaaggtcgtttaccg

SEQ ID NO: 339241 - DNA, 515 bp, Homo sapiens
  misc_feature: GZ8MTXP02G5XNR.38.53.E09.1.454.CMB.2.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (475)..(475): a, c, t, g, unknown or other
  misc_feature (475)..(475): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggganacttggtagagcctgggcaggtccctgagactctcctgtgcagcctctggattcaaatttaangataatgaccatgcactggccacaagctccgagggaaggcctggagtgggtcncaagtgttagtggaacagtggtaccagtagcctatgcggactcgtgtcgaaagggtccaattcaccatctaccagagacaacgccaaagngactccngtatcngacaaaatgaacagatgagacagagacgacgctctattctntgacaaacgaccgtaacgtagacgagagacacgagttacg

SEQ ID NO: 339242 - DNA, 669 bp, Homo sapiens
  misc_feature: GZ8MTXP02GT0UP.38.53.E09.1.454.CMB.2.raw
  modified_base (219)..(219): a, c, t, g, unknown or other
  misc_feature (219)..(219): n is a, c, g, or t
  modified_base (281)..(281): a, c, t, g, unknown or other
  misc_feature (281)..(281): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacgttggtagagcctggcaggtccctgagactctctgtgcagcctctggattacaaatttangataatgaccatgacacgtgggtaccaacaacgccgtaccgaaggggaacgggtccctagggagttcggggtctacgtaaggtggtttagttaggaactaggtcgtaacctagtacgaccttgtcgacggtactcgtaggtggaaacgggccgtattaccacctatcctaccgaagtaccgaaccaaaccggacccaaagggtaccgacccttacccgttagtaacgttcctagaaaccaaagttaacgaaacacgtacgtacgaacgaccctaggaacgtacgaacggtcccttacgtttaactttcgtacggttacgaaaccgtaaaaccgggtccccggtaagtacggtatacggtaacgtacgtaaaacggtcggttttacccg

SEQ ID NO: 339243 - DNA, 565 bp, Homo sapiens
  misc_feature: GZ8MTXP02ITO5F.38.53.E09.1.454.CMB.2.raw
  modified_base (443)..(443): a, c, t, g, unknown or other
  misc_feature (443)..(443): n is a, c, g, or t
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctatttaaaggtgtccagtgtgaagtgcagctggtggagtcgtgggggagacttggtagagcctggcaggtccctgagactctcctgtgcagcctctggattcaaatttatgataatgccatgcactggtccgacaagctaccgagggaaggcctgggagtgggtctcgagtgttagttggaactagtggtaccatacgcctagtgcgactctgtgaacgggccattcacatctacagagacaacgcaaagagctccctgtatctgaccaaatcgaaacngtactgaacgccgtagacggacaaccggtcctttacttactttacctgttacgaaccgtaaaacggggtcccccggttaagtacgggacctaaggtacgaccgttaaggtacggttttaccg

SEQ ID NO: 339244 - DNA, 613 bp, Homo sapiens
  misc_feature: GZ8MTXP02JXGPD.38.53.E09.1.454.CMB.2.raw
  modified_base (219)..(219): a, c, t, g, unknown or other
  misc_feature (219)..(219): n is a, c, g, or t
  modified_base (285)..(285): a, c, t, g, unknown or other
  misc_feature (285)..(285): n is a, c, g, or t
  modified_base (515)..(515): a, c, t, g, unknown or other
  misc_feature (515)..(515): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccaagtgtgaagtgcagctggtggagtcgtggggganacgttggtagagccgtggcaggtccctgacgactctcctgtgcagccctgtgtattacaaatttangataatcgccatgctagtcgggtaccacagcctacggaggggacgggcctgggagttgggtctacgtaaggttgttaggtacggaacgtggtacggtaaccagtacgccttagtcggcggtactgtgtaggaaacgggtccgtattaccaccatacctaccgagacgaaccaacgaccgaagacgcctaccgtgtactcgtagaacaagtagaactgtactgacgtacgngaacggactaccggttccttattacgtttcctaggtaccgtaacgtaaaacccggtcccggtaagtcggtacaggtacgtacgttaaggtacgtttcg

SEQ ID NO: 339245 - DNA, 639 bp, Homo sapiens
  misc_feature: GZ8MTXP02JMAL0.38.53.E09.1.454.CMB.2.raw
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctaattttaaaaggtgtccagtgtgaagtgcagctggtggagtcgtggggganacttgggtagagccgtggcaggtccctgacgactctcctgtgcagcctcnggattcaaatttaangataatgccatgccagtggtccgacaagctccgaggggaaggcctgggagttgggtctacgaaggtgttagtacggaacaggtcgtaaccatacgcctagtggacggctcgtgtacggaaacgggccgtattcgacccactacctccgaacgacgaccgaaaccgacccgaaagacgacccttacccgtagttactcgtacgaaccaaaatacgaaactagcgtacggacgtacccgtagacggaaccgtaccggtacccgtttacttacgttttacgtacggtacgtaaaccggtaaaacgggtcccccggtaagttcggaacgtacggtacgtacgttaaaaggtcggtttaccg

SEQ ID NO: 339246 - DNA, 559 bp, Homo sapiens
  misc_feature: GZ8MTXP02FQTP1.38.53.E09.1.454.CMB.2.raw
  modified_base (367)..(367): a, c, t, g, unknown or other
  misc_feature (367)..(367): n is a, c, g, or t
tcagtcgatcacgtcacgaccggtgctcgatttagagagagtgtgttgggtttgggggaagaggaagactgacggtcctgccacaggtggtgctgggcacggtgggcactcgacacaacatttgcgctcaactgtcttgtctcaccatggagttgggactgagctggattttcctttggctattttaaaaggtgtccagtgtgaagtgcagctggtggagtctgggggagacttggtagagcctggcaggtccctgagactctcctgtgcagcctctggattcaaatttaatgataatgccatgcactgggtccacaagctccgagggaagggcctaggagtcgggtctcgaagtgttagtggaacngtggacatagcctatgcggactcgtgtgaagggcattcaccatctccaagacgaacaaccgaccaaagacgtactcccctagtaactctacgacaaatcgaaacagtctagacgtaccgtggaacggaccacggtcccttacttacgtttccgtggtacgacgaaaacggtcccccggtaaagtcggtaacg

SEQ ID NO: 339247 - DNA, 682 bp, Homo sapiens
  misc_feature: GZ8MTXP02IL6PE.38.53.E09.1.454.CMB.2.raw
  modified_base (216)..(216): a, c, t, g, unknown or other
  misc_feature (216)..(216): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
  modified_base (551)..(551): a, c, t, g, unknown or other
  misc_feature (551)..(551): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcacatggagttgggactgagctggattttccttttggctaattttaaaaggtgtccagtgtgaagtgcagctggtggagtcgtggggganacgttggtagagcctggcaggtccctgagactctcctgtgcacgccctcgtggtattactaaatttaangaataatcgaccatgaccagtcgggtaccganaacgctaccggaaggggaacggccgtagggaggtgggtctacgtaaggttggttaggttacggaaacgtaggttacggtacctaagtacgtaccttagtcgggtaggtacttacgtggtacggaaacgggtccgtaattcccaaccgtatccctaccgaaggaacgaaccaaacccgtacaaagaccgtccgttacccctagttactccgtagaacctaaaagtgaaaacccgngtacctaggaacgtacccgtaagggaaacgggaccctacggttcccttttattaacgtttcgaggtcgaaaaccggtaaaccggcccggttaagcgaaccgtaagacggacttaaggttcggttttaaccg

SEQ ID NO: 339248 - DNA, 663 bp, Homo sapiens
  misc_feature: GZ8MTXP02H41PX.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggcttaattttaaaaggtgtcagtgtgaagtgcagctggtggagtcgtgggggatacgttggtagagccgtggctaggtccctgagactctcctgtcgcacgtcctcgtggtattactaaaattttaaatgtaataatcgacctaagttcggaccgtacgtcggggtacccgaacgaaacgcccgtaccggagggggtaaacgggccgtagggacggttggggtcctagtaaaggttagtttaggttacggaacgtaggtacgtaacctagttacgccttagtcggtcggtacttcgtaggttagggaaacgggtcccgtaatccgaacctatcctaccgagacgaccaaacgccaaagcgcctacctgtaatcctgactaaagtcgaactacgtacgtagacgtacgtagacgaaacgtccgtactttcgtactttcgacgtacgaaccgtaaacggcccgttaagcggactaggtacgacgttaacggtacgtttaccg

SEQ ID NO: 339249 - DNA, 671 bp, Homo sapiens
  misc_feature: GZ8MTXP02IAYPE.38.53.E09.1.454.CMB.2.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (450)..(450): a, c, t, g, unknown or other
  misc_feature (450)..(450): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgcagctgggtggagtcggtggggganacgttgggtagaggcctgggcacggtccctgagactctcctgtgcacgccctntggtatactaaatttangaataancgcctatcgcgacgtcgggtaccaacaacgtccgtaccggaggggaacgggtccgtagggtacggttgggtctacgtaggttcgttaggtacggaacgtaggtacgtactatacgctagtgcgactcgtgacggagtcatccactatccncaagacacgaacgacaagcctacctaccgtgtactcgtagaactaaacgtagaaccgtgtcgtaacggacgtaccggtaggaaccgggtacctaccggtttaccctttaggtttacctttaccggaggtaacccggtaaaccggttaaaacccggggcccgtttaagggcgtaacccggtaagggttaaacttccggttaaaagggttttcccggtttacg

SEQ ID NO: 339250 - DNA, 712 bp, Homo sapiens
  misc_feature: GZ8MTXP02GSVBB.38.53.E09.1.454.CMB.2.raw
  modified_base (284)..(284): a, c, t, g, unknown or other
  misc_feature (284)..(284): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctgggtggagtcgtgggggatacgttggtagagccgtggcaggtccctgagactctcctgtgcagcctctggattacaaatttaangaataatgaccaatcgctaacgtcgggtacccgaactaacgccttacccggaagggggaacgggtcccgttaggggacgttcggggttctacgtaaggttaggtttaggttaccggaaacgtagttacggtaaccaagtacgccttagtcgggacggtaacttcgtggtacggaaacgggtccgtacttccgaaacctaagttcccacccgaaggaaacgaacccgaaaccggacccgaaaggacgtcccgttaccccgttagtaacttctaacggaaccaaaagttcgaaaaccgtagtcctaaggacaacccgttagggaaacgaccgtacggttccctttattaaactttcgtaaggttccggaaaaccgaaaccgggtccccggtaagtcggaaccgtaggacgtacgtaaagtcgttttaccg

SEQ ID NO: 339251 - DNA, 705 bp, Homo sapiens
  misc_feature: GZ8MTXP02HYDXM.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagacgttggtagagccgtggcaggtccctgacgactctcctgtgcacgcctcgtgtattactaaatttaatgaattaatcgacctagtgcctacgtcgggtccgaacgaagccctacggaggggaacgggtccgtagggtacggtggggtactacgtaaggttaggttaaggtttacggaaactaggtcggtaaccattacggtacctagtcggacggtaccgtttcgtagggttacggaaacgggggtccctattaccaaccctactccctacccaagtaaccgaaccaaacgacccgtaaaagcgtccttaccccgtagtaccttacgtacgactaaaacgtcgaaaaccgtagttaccgtgtaaacggacccgttagggaacgaacccgtcggttacccttttctaacgttttcgacgttacggaacccgtaaaaccgggtccccggtaagtcggacgtaagtacggtacgtaggttacggtttcg

SEQ ID NO: 339252 - DNA, 634 bp, Homo sapiens
  misc_feature: GZ8MTXP02FZMXP.38.53.E09.1.454.CMB.2.raw
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (482)..(482): a, c, t, g, unknown or other
  misc_feature (482)..(482): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggctattttaaaaggtgtccagtgtgaagtgcagcgtggtggagtcgtgggggagtacgttggtagagcctggcaggtccctgagactctctgtgcagctntgattacaaattatgataatgcatgcacgtggtaccanaacgctaccgaggggacggcctgggaggtgggtctagaaggtgttagtggaacngtaggtacagtacgcctagtcgcgtactcgtggtagacgggtccgtattccgacctagtcctacgagaacgaccaacgacctaagacgtccttacccgtgtactcgtacaacgtaaaatacgaaacncggttcacggaaacggtaccctaggggaaacggaaccgtacgggttacccctttagtttacttttccggtacgttacggtaacccggaaaacgggttccccggttaaaggcgtaacggaaggttacgtaacgttaaggttacggttttaccg

SEQ ID NO: 339253 - DNA, 699 bp, Homo sapiens
  misc_feature: GZ8MTXP02I61W9.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttcctttggctattttaaaaggtgtccagtgtgaagtgcagctgggtggagtcgtgggggagacgttgggtagagcctggcaggtccctgagactctcctgtgcagcctcgtggtattacaaatttaatgaataatcgacctatcgactacgtcggggtaccgaacaaggtcctacccggaaggggaacggggtcccgtaggggtaggttcgggttacctacgtaaaggttggtttaacggttacgggtaaacgtaggttacgggtaaccctagtacgacctagtcgaccggtacttccgtaggtagggaaacggggtcccgtaactaccgaccctaatcccgtaacccgaagaacgaacccgaaccgaccaaaggacgccttacccgtagttactacgtagaactaaagtacgaaacgtagtcctaggaacgaccgtaggaacggtaccgtaccggtcctttagttactttcgacgttacgaaaccgtaaaaccgggtcccgtaagtcggaactaaggtacgtaacgtaggtacgttttacg

SEQ ID NO: 339254 - DNA, 632 bp, Homo sapiens
  misc_feature: GZ8MTXP02G8N76.38.53.E09.1.454.CMB.2.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (282)..(283): a, c, t, g, unknown or other
  misc_feature (282)..(283): n is a, c, g, or t
  modified_base (287)..(287): a, c, t, g, unknown or other
  misc_feature (287)..(287): n is a, c, g, or t
  modified_base (292)..(293): a, c, t, g, unknown or other
  misc_feature (292)..(293): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtggggganacttgggagagcctggcaggtcccngagactctcctgtncagcctnggatacgaaattttaannatancacannacgcgtcggaccacacgcgacgagggacgtcgtggaggtcgtctagtagttaggtagtacgaagtgtacgtaactagtacgcgtgtcgcgtactgtaggaggacggactataccacctactcgacgagacaaccgaaccgaaccgaacgtacgtacctacgttacgtactacgtagaaactaagacgtaaacgtacgtacgtacgacgtaccgacgggaaccgtaacccgtaccgttaccttacgtttacgttacgtaacggtaccgaaaaccggtaaacccgggtacccgtaaggacgtaaacggtacgtaacgtaaccgtaacggtttacgtttacg

SEQ ID NO: 339255 - DNA, 530 bp, Homo sapiens
  misc_feature: GZ8MTXP02F8EIR.38.53.E09.1.454.CMB.2.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
  modified_base (469)..(469): a, c, t, g, unknown or other
  misc_feature (469)..(469): n is a, c, g, or t
  modified_base (516)..(516): a, c, t, g, unknown or other
  misc_feature (516)..(516): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggganacttggtagagcctggcaggtccctgagactctccngtgcagcctctgattcaaattatgataatgcatgcatggtccanaagctccgagggaggctggagtgggctanagtgtagttcggactagagtaccatacgcctagcgcggactcgtgtagaagggcccatcaccatcnccagagacaacgccaagacgctccctagtatctgacaaagtgaactagtctagacgacgtagaggactaccggtccttntactttctagtacgacgaaacggtccccggtaatcggtacacggtancgtaagacggtttc

SEQ ID NO: 339256 - DNA, 676 bp, Homo sapiens
  misc_feature: GZ8MTXP02I8PUV.38.53.E09.1.454.CMB.2.raw
  modified_base (216)..(216): a, c, t, g, unknown or other
  misc_feature (216)..(216): n is a, c, g, or t
  modified_base (575)..(575): a, c, t, g, unknown or other
  misc_feature (575)..(575): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggganacgttggtagagcctggcagggtccctgagactctcctgtgcagcctctggattcaaatttaatgaataatgccatgcacgtgggtccgacaagcctacgaggggaacggccgtgggaggtgggtctacgaagttgttagtacgaacgtagtgtacagtacgcctatcggacggtacttcgtggtacggaaacgggccgttaaattccgaaacccgatttcccgaaccgaggtaaacgaacccaaacgacccgaaagacggtcccttacccgttaggtaactacgttcggaaccaaaagttcgaaaacctaggttccgtaggaaacgtccgtaggaacgaccgtaacgggtcccctttnttacgttttacgcggttacgaaccgaaaaccggggttccccggtaagttacgggacccttaaaagggacccgtacggttaaagggttaacgtttttccggg

SEQ ID NO: 339257 - DNA, 631 bp, Homo sapiens
  misc_feature: GZ8MTXP02GJON6.38.53.E09.1.454.CMB.2.raw
  modified_base (215)..(215): a, c, t, g, unknown or other
  misc_feature (215)..(215): n is a, c, g, or t
  modified_base (483)..(483): a, c, t, g, unknown or other
  misc_feature (483)..(483): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtggggganacttggtagagcctggcaggtccctgagactctcctgtgcagccctctggattacaaatttaatgaataaatgacctatcgactacgtcgggtaccgaacaaagccgtaccgaggggaacgggcctagggacggtggggtacctacgaaggtgtttaggttacggaaagtagtacggtaacctagtacgacctagtcgcgggtactcgtagtagaaacggggtccaattccacctagtctaccgagacaacgaacgacccaaagaccnccttaccgtagtactctacgaacaaacgtagaaactagtcgaggaacgtaccgaggaacggaccgtaccgtctttattacttcgacgtacgaaccggtaaccggtccgtaagtcgaacgtacgtacgtacgttaacggttacgtttcg

SEQ ID NO: 339258 - DNA, 805 bp, Homo sapiens
  misc_feature: GZ8MTXP02H7TZC.38.53.E09.1.454.CMB.2.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagtcgatcacgtcacgaccggtgctcgatttagagagagtgtgttgggtttggggggaagaggaagactgacggtcctgccacaggtggtgctgggcacggtgggcactcgacacaacatttgcgctcaactgtcttgtctcaccatggagttgggactgagctggtattttccttttggcttaattttaaaggtgtccagtgtgaagtgcagctgggtggagtcggtggggganacgttggagacgccgtggcaggtccngacgactctcctgtncacgtctctagtatactaaatttanagtaataatcgcctaatcgacgtacgtcgggtaccgaacacgtccgtcggaacggggaaacgggtcgtaggagggtcggtactacgtaaggttcggttaagtacgggtaactgggttacggtaaactaggttacgtacgttacgtacgggtaccggtacttcgtacggggttaacggtaaacgggggtacccgtaaacgtttaccccgtaaacccgtacgtttaaccccgacccgggaaagaaacccggaaaccgaaaacccggaacccggtaaaacggtacccgttccccgttaaccccggttacgggtttaaccttaccgtacgtaaaacccggtaaaagttaccgaaaaccgttacgttcccgttaaggaaccggttaccggacgggtaaaacggtaccccggtacggttaaccctttttcgttaccgttttaaccggtaggtaaaacccggttaaaacccggaaaccgggtttccccggtaaaagtacggggtaaacg

SEQ ID NO: 339259 - DNA, 672 bp, Homo sapiens
  misc_feature: GZ8MTXP02FW4BV.38.53.E09.1.454.CMB.2.raw
  modified_base (284)..(284): a, c, t, g, unknown or other
  misc_feature (284)..(284): n is a, c, g, or t
tcagtcgatcacgtcacgaccggtgctcgatttagagagagtgtgttggggtttgggggggagaggagccccagccctgagattgccaggtgtttccattcagtgatcagcactgaacacagaggactcaccatggagttgggactgagctggtattttccttttggcttattttaaaggtgtccagtgtgaagtgcagctggtggagtcgtgggggagacgttggagagccgtggcacggtccctgacgctcctctgtcgcagcctctggattacaaatttangtaataatgaccagtgcacgtcgggtccaactaagcctaccggaaggggaacggtccgtagggaggttcgggtctacggtaaaggtttggttaaggtttacggaaacgtaggttacggtaacctaagtacgtcgtaatcgggacgtacctgttaggtacgggacggggtccgtaagtttacccaccgtagttccctaacgaacgaaccggaaccaaaccggaccgaaacgcgtacccttacccgtaggttaacctcgtacgaactaaagtacgaactacgtacgtacgacgacgtagacggaacgtcgtaccttactacttcgtacgtaacgtaccgaaaacgggtccccgtagtacggtacgaagtacgtaacggttacggttacgg

SEQ ID NO: 339260 - DNA, 712 bp, Homo sapiens
  misc_feature: GZ8MTXP02HWAQT.38.53.E09.1.454.CMB.2.raw
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggganacgttggagagcctgggcacggtccctgagacttctctgtcgcacgtccctgtaggtattacaaattttaangtaataatgccaagtcgactacggtcggtaccgacgaacgccgtacggaaggggaacggtccggtagggtaggttcggtacctagttaaaggttggtttaacggtaaggaaacgtagggttacgtaacgtagtacgtaccgttagtgggtaccgtacctttcggtagttacgggaacgggacccttacttacccaaccgtacttacccgaaccgaaggaaccgaaaccgaaaccgaacccgttaaagggacctcccgttacccgttaagttacctagtaacgaaaccttaaaagcgtaaacgtcgacgttaagaccgtaaccgtagaaccggaactaccggtcctttagttaacttccgtagtaccgaaaccgaaccggtcccgtaagtacggactaggtagtaccgtaaagttcggtttccg

SEQ ID NO: 339261 - DNA, 669 bp, Homo sapiens
  misc_feature: GZ8MTXP02G57CA.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagacgttggtagagcctggcaggtccctgagactctcctgtgcagcctctggtattactaaatttaatgtaataatcggccaagtcgactacgtcggggtaccgaacgaaacgccgtacccggaggggaacgggtcccgtaggggaggtcggggtcctacgtaaaggttggtttaggttacggaaacgtaggttcgggtaaccagtacgtccctagtcggcggtacttcgtagtggaacgggccgtacgttcaacctataccgtccgaagacgaaccaacgaccgaaacgacgtcctacccgttagtactcttacggacaaaagttcgaacctaggttcctagacgacctagggacgtaccgacggttcctttacgttactttcgcgttacgaaccgtaaacgggccccggtaagtcggactaacggtacgtaacgttaacggtacggttttcccg

SEQ ID NO: 339262 - DNA, 1030 bp, Homo sapiens
  misc_feature: GZ8MTXP02H6WJ6.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcggtgggggagacgttggtagacggtcctgggccaggttccctgacgtactctcctgtgcctacgcctcgtggtacttactaaatttaatagtaataattcgacctaagtcgaccgtaacggtttaccggggacccgtaaaccaacggtacccggtaccccggaaaggggggtaaaccccggggtcccggttaagggggtacggggtttacgggggttaccccgttaaaccggttaaaagggttttacggggttttaaagggtttaacccgggggtaaaaaccgtttacggggtttaacccggggtttaaaaccccctaaaggttaccggttacccccgtttaacgggttccggggtaaccggggtaaccgtttaacccgggtttgggggtttaacgggggaaaacccggggggttaacccccgggttaacgttttaacccgaaaccccttaccgtttaacccgtaacccggaaacggtaaaccggaaaaccccgaaacccgttaaaccccgaaaaacgggttccccggacccctttacccccggttagttaaaaccttccccgggttaaaacgtaaaccgttaaaacgtaaacgtaaaccgttaacggttaccggtaaacggtaaaccggtaaccggttaacggaacccgggtaacccgttaacccgggtttaccgttttaaacgtttaccgtttttaccggtaaacgggttaaccggtaaaaaccccgggttaacccggggttaacccggttaacggttaccggtaacggtaaaacggttaacgttaaacgggttaaacgggtttacggttttaacgg

SEQ ID NO: 339263 - DNA, 676 bp, Homo sapiens
  misc_feature: GZ8MTXP02HOOFH.38.53.E09.1.454.CMB.2.raw
  modified_base (251)..(251): a, c, t, g, unknown or other
  misc_feature (251)..(251): n is a, c, g, or t
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtgggggagtacgttgggtagagccgtggcaggtcccngacgctctcctgtgcacgcctctggtattactaaaatttaatgaataatcgaccagtcgactacgtcgggtaccgacgtaacgccgtaccggaaggggaacgggccgtaggggtaggtcgggtccgtagtaaggtaggtttaggttaacggaacgtaggttacggtaaccagtacgtacctagtcgggacgtactcgttggtacggaacgggtccgacgttccaaccgtactccgacgtaacgacgaaccaacgaccaaacgacgtcctaccgttacgtacttctagaactaagtacgaaacctagtacgtacggaacgtaccgaggaaccggtaccgtacccgtccgtttacttacgtttcgtagtacggaacgtaaacggccggtaagtcggactaaggtacgacggtaagttacgtttaccg

SEQ ID NO: 339264 - DNA, 728 bp, Homo sapiens
  misc_feature: GZ8MTXP02JY2CU.38.53.E09.1.454.CMB.2.raw
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacttggtagagccgtggcaggtccctgagactctcctgtcgcagcctcgtggtattactaaatttaatgaatatcgaccagtcgctaacgtcgggtaccacgaaacgtccgtaccggaaggggaacggccgtgggagtgggtctacgtaaggttcgttaggtacggaacgtggtacgtacagtacgaccttagtcggaccggtacttcgtaggtacggtaaacggggccgtacttacccaacccgtactcctacccgaagacgaaaccgaaacccgaccgaaaggtacccgtacccgttacccgtaggttaacctcgttaacgaacctaaaagtacgtaaacctacgttaccgacggtaacggtacccgttaagggaccggtaacccggtaccggttaccctttacttacgttttcgtaacggttaccggaaaaccggtaaaacccggggtcccgttaaggacggtaccggtaagttaccgaaaggttaaccggttacgggttttccg

SEQ ID NO: 339265 - DNA, 708 bp, Homo sapiens
  misc_feature: GZ8MTXP02JQ00J.38.53.E09.1.454.CMB.2.raw
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagcgtggtggagtcgtggggganacgttgggtagagccgtggcaggtccctgagactctcctgtgcacgcctctggtattacaaatttaangaataatcgaccatcgacacgtcgggtaccacacgccgtaccggaaggggaacgggtccgtaggggtaggttcggggtctacgtaaggttggtttaggtacggaaacctaggttacggtaacctagtacgtccttagtcgcggtacttcgtagggtacgggaaacgggtcccgtattccgaaccctacttccgtacccgaaagaacgaacccaaacggacccgaaaggaccgtaccccttacccgtagttactaccgtagtaactaaaacgttagaaacctaggttacctaggaaccgtacccgtaggaacgacccgtacggttccctttacttaacgttttcgaggttaaccgaaaccggtaaaacccgggtcccggttaagcggagtaacggtacgtaacgttaaggtcggttttaccg

SEQ ID NO: 339266 - DNA, 703 bp, Homo sapiens
  misc_feature: GZ8MTXP02HUGQX.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacttgggtagagtccgtggctacggtccctgacgacttcctccgtgtcgcacgtccctcgtggtacttactaaatttaatgtaataatcgacctaatcgacgtacggttcgggtacccgaacaaacgcccgtaccggaaggggaacgggtccgtaggggtacggttcgggtactacgttaaaggttcggtttaaggttacggaaaccgttaggtacggtaaacctagtacgtcttagtggttacggtaccttcgtagggtacggaacgggtcccgtattcccaacgtctcctaccgaagacgaaccgaaacgaccgaagccgtacctcccgttagtactcgtacgaactaagtacgaaaccgtgttacctaggacgttaaccgaggacgacctcggtccttttgtaactttcgtacgacgtaaaccgtaaacccggggtcccgtaagtacggaacgtagaacgtaaccgtaggtttacgtttcg

SEQ ID NO: 339267 - DNA, 661 bp, Homo sapiens
  misc_feature: GZ8MTXP02IDEOI.38.53.E09.1.454.CMB.2.raw
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
  modified_base (437)..(437): a, c, t, g, unknown or other
  misc_feature (437)..(437): n is a, c, g, or t
  modified_base (498)..(498): a, c, t, g, unknown or other
  misc_feature (498)..(498): n is a, c, g, or t
tcagtcgatcacgtcacgaccggtgctcgatttagagagagtgtgttgggtttggggggaagaggaagactgacggtcctgccacaggtggtgctgggcacggtgggcactcgacacaacatttgcgctcaactgtcttgtctcaccatggagttgggactgagctggtatttttccttttggcttaagttttaaaaggtgtccagtgtagaagtgcagntggtggagtgtgggggagtacttggtagagccgtggcaggtccctgagactctcctgtgcagcctctgattacaaatttaanagtaataatcgaccagtcgacctacgtcgggtaccaacgaaagccgtacggaaggggtaacggcgtaggaggtcgggtctacgtaagtcgttaggtagaatggtaggtaaccagtacgacctagcgcgacttcgnggtacggaacggtccgatacccgactactccaccgagaacgaacaacgaccgaaggtaccncgttaccgtagtactacgtacgaactaaactacgaaacgtacgtacggtacgaaacgtaccggtaacggaaaccggtaccgtacccggttaccttttaacgtttactttccggtaagtaaccgaaaaccggtaaaacccgggtcccggtaaagtccggaacgg

SEQ ID NO: 339268 - DNA, 862 bp, Homo sapiens
  misc_feature: GZ8MTXP02ITIJW.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagcgtgggtggaggtcgtgggggagtacgttgggtagacggtccgtgggcgtacggtccctggacgtacttccttccgtgtcgcacgtcctcgtggtaattactaaatttaatgtaataatcgacctagtgcctaacggtcgggtaccgaacaaacggtccgtaccggaaggggaaaaccggggtccggttaggggtacgggttacggggttccgttaaccggtaaagggtttacggtttacgggtttaacggggtaaaaccgttacggggttacgggttaaacccccgtaagtttaacccggtcctttaacgggttcggtacccggggttaccgttaccggttacgggggtaacggggtaaaaccgggggtcccgttaaacgttacccgaaaccctacgttacccgtaccgtaaacggaaacgtaaacccgaaaccggtaacccgaaaacggaccgtcccgtttacccgtaaggtttaccttaccgtacggtaaacctaaaagggttaaccaaacgtacggttacgtaggaaaccgttaccggacggtaacggtaacccgtccggtcccttttattacgtttcgacgtacgtaaacccgtaaccggtaccggtaacgtacggtaccgtaaaggtacgtaaccggttaaaggttacggtttcccg

SEQ ID NO: 339269 - DNA, 680 bp, Homo sapiens
  misc_feature: GZ8MTXP02F0VWC.38.53.E09.1.454.CMB.2.raw
  modified_base (534)..(534): a, c, t, g, unknown or other
  misc_feature (534)..(534): n is a, c, g, or t
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggtattttcctttggacttaattttaaaaggtgtccagtgtagaagtgcagctgggtggagtcgtgggggatacgttgggtagagccgtgggcgtacggtccctaggacgaccttcctccgtggtcgacctacgcccttcgtaggtaacttaactaaaatttaatgtaataagtcgacctagtcgactacggttacggaccgaacaacggccgtacccggaagggggaacgggtccgtaggggtacggtcggggttacctacgtaaggttaggtttaggtaacggaacgtaggtacgtaacagtacgaccttagtcgacgtactccgtaggtaggaaacgggtctactaccgaccatccacgaaggacacaacgacgaagacncctacctgtactctagaactaagtacgaaactcgtataggacgacgtacggacgtaaccgtaccgttctttacttcttacgtacgacgtaaacgaaccggtccggtaagtacggacgtaagacgttacgtaacggttacgtttacg

SEQ ID NO: 339270 - DNA, 698 bp, Homo sapiens
  misc_feature: GZ8MTXP02FY01U.38.53.E09.1.454.CMB.2.raw
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagacttgggtagagcctggcaggtccctgagactctcctgtgcagcctctggattcaaatttangataatgcatncactggtccgacaagctccgagggaagggcctagggagtgggtctcgaagtgttaggttggaactagtggtaacctagtaacgcccttagtcggcgggtaacttccgttgggtaacgtaacgggggacccctatttaacccgacccaaagttcccttccccgaaagacggtaacccaaaacgggccccaaaacggacggccctttccctaaccgggttaaancccggtttanaaccgtaaaatacgaacctaacggtacctaggtaaccgtaccgtacggacgggaaccgtaccgggttacccttttacgtacttttacggtacggttaccgaaaccgtaaaaccggggtacccccggttaagtaaccggtacgtaacgggtaacgtacggttaacggtaaccgtttcgg

SEQ ID NO: 339271 - DNA, 839 bp, Homo sapiens
  misc_feature: GZ8MTXP02JV632.38.53.E09.1.454.CMB.2.raw
  modified_base (218)..(218): a, c, t, g, unknown or other
  misc_feature (218)..(218): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtggggganacgttggtagagccgtggcacggtccctgacgactctcctgtgcacgcctcgtggtattacgtaaatttaatcgtaataagtcgacctaagtcgaccgtacgttacggggtacccgaaacgtaacgtccgtaacccggaagggggtaaaccgggtccgtaggggtacggttcggggtaccttacgtaaaggtttcggtttaacggttacgggaaaccgttagggtacggtaaccagttacggaccttagtccgggtacggtaaccttcgtacgggtaacgggtaaacggggtacccgtaacgtttacccaaaccgtacgttaccgtaacccgaagggaaacgaacccgaaaccggaacccgtaaaagggacccgttaccccgttaccccgttaagggttaccttaccgtaacgtaaacctaaaacggttaccgtaaaaccgtacggttaccgtaacggaacggtaacccgttagggaaaccggtaacccgtacccggggtttacctttacgtttacgtttaccggtacgtttaaaccggaaaccggtaaaacccggggtccccggttaagtcgggaaccgtaaggtaaccgtaacggtttaaacggtacggttttacccgg

SEQ ID NO: 339272 - DNA, 653 bp, Homo sapiens
  misc_feature: GZ8MTXP02JDE3J.38.53.E09.1.454.CMB.2.raw
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (495)..(495): a, c, t, g, unknown or other
  misc_feature (495)..(495): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtggggganacgttggtagagcctggcaggtccctgagactctcctgtgnacgctctggattacaaaatttangaataatgacctatgacctacgtcggggtacccaagaacggaccgtacccggaaggggtaacgggccgttagggacggttcgggtacctacgtaaaggtgtttaaggtacggaaactggtacggtaccatacggctagtcgacggtactcgtggtacggaacgggtctattccgacctanccgtacaganaccaacgcaaagctcctacccgngtatcgagtacaaagtgaaacctgtactggaacgaccgtggaaccgaccgtacggttccctattacgttttaccgaggttaccgaaaacccggtaacgggtaacccccggttgacgggtaactaccggggtaatacccgttaaggtaacgttttccgg

SEQ ID NO: 339273 - DNA, 754 bp, Homo sapiens
  misc_feature: GZ8MTXP02HYMW7.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttaatttaaaaggtgtccagtgtgaagtgcagcgtggtggagtcgtgggggatacgttgggtagaggtccgtgggctacgggtcccctaggagtacctccttccgtggtcgccacgtcccgtcgtggtaacttactaaaattttaatagaattaaatcgcctaagtcgacctaacggtcgggtacccgaacaaacggccgtaaccggaaggggtaacggtccgttaggggaggttcggggtacctacggtaaaaggttcggtttttaaggtaccgggtaaaacgtacgggtttacggtaaaccctaagttaaccggtccctaggtacggaccgggttacttcgggtaaggtacgggaaacgggtccctagtacccacctacgtccaaccgaagaaacgaacccgaacgtaccgaaagggcctccctccggttaatacttcgagaaactaaacgtacgaaaccgttactacgaaggaacgtaccggtaggaaaccgtaccgtccgttacctttagtacgttcgtacgaaccgaaaccgtaaccggtccgtaagcgtaacgtacgtacgtaaggttacggttacgtttacg

SEQ ID NO: 339274 - DNA, 765 bp, Homo sapiens
  misc_feature: GZ8MTXP02FM7PM.38.53.E09.1.454.CMB.2.raw
  modified_base (662)..(662): a, c, t, g, unknown or other
  misc_feature (662)..(662): n is a, c, g, or t
tcagtcgatcacgtcacgaccggtgctcgatttagagagagtgtgttggggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgcagctgggtggagtcgtgggggatacgttggtagagccgtgggccgacggtccctggacgactcctcctgtgcacgcccttgtgtattactaaatttatgaataatcgcctagtcgacgaccggtcgggtaccaacgaacgcctacggaaaggggaacggggtccgtgggaggttcggggtccttagaaggttaggtttagtacggtaacgaggtacgtacctaagtacgcttagtccggacggtacctacggtggttaaacgggacggggtaccctacgttaccaacccgtacttccgtacgaaacggaaccgaacccgaaacggtaaccccgaaaggaccggtaccctttacccccggttagttaacgtttacccgaacgtaaacgtaaaagtttaccggaaaccctagtacccggtagaaacggtccgtaacgggaaacgtcccggtaacggtttccctttntttaaacctttcggtacgtaacccgaaacggtaaacccccggccgggttaagtcccgggtaaattcgggtaaacttacggttaaacggttcggtttttaaccg

SEQ ID NO: 339275 - DNA, 789 bp, Homo sapiens
  misc_feature: GZ8MTXP02GLW4K.38.53.E09.1.454.CMB.2.raw
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggtattttccttttggcttaattttaaaaggtgtcagtgtgaagtgcagcgtgggtggaggtcgtgggggatacgttgggtagagccgtggcgacggtccctggacgacttctcccgtgtcgcacgcccgttcgtaggtattaacctaaaattttaagtagtaaattaagtcgtaccgtaactcgaccgtaccggtttacggggtacccgaaaccgaacggacccgttaaccgggaagggggaaccgggtccgtaacggggtaggttcggggttacctagttaaggtttaggtttaaggtacggaaaacgtggttaccggtaacctaagtacgaccgtagttcggaccggtacttacgttgggtaacgggtaaacggggacccttagtacccacccgtattcccgtacgaagacgaacccgtaaacgacccaaagggtccnccttaccccggtnttacgtactaggaaacttaaacgaagtaacccgtaggttacacgggtaaccgtacggtaacggacggtaaacccgtaccggtttaaccttttgttaaacctttccggacgttaacccggaaacgtaaacccggggtccgaaggttaccgagtaacggtaccgtagttaacgggttcttttaccgg

SEQ ID NO: 339276 - DNA, 904 bp, Homo sapiens
  misc_feature: GZ8MTXP02F2UV6.38.53.E09.1.454.CMB.2.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggcttattttaaaaggtgtaccagttgtgaagtgcagctgggtggagtcgtgggggagacttgggtagacgcctggcaggtccctgaacgacttccgtccgtgtcgcagaccctgtcgtaattactaaattttaatgtaataatcggacctatgaccgtcgtacgggtccgaactaagccgtaccggagggggtaacggccgtgggaaggttcgggttcctacggtagtttacggtttaggttaggggtaaacccgtaggggtaccggttaaacccgtagtaacccggtacccgtttaggtccgggtacccgggttaaaccgttcgttaccggggttaaggggtaaaacgggggccccccgttaaagttttacccccgaaccctaacctttaacccggtacccccgaaaaggggttaacccccggaaaccaaaacccggaaccccgtttaaaaacggggcccctacccccgtttaaacccggggtatttaaacgttaccccggtcggaaaacccttaaagttaaacccggaaaacccttgggtttcccgtaaagggaaaaccggtccccttaagggggaaaacccgttaccccggttacgggtttaccccctttaatttacccgttttagtaccggaaaacgggttaccgggaaaaaccccggggttcccgttaaaggggtaccccggacgttaaaacgttagggtaacccggttaaaaggtttccggggtttttaaccccg

SEQ ID NO: 339277 - DNA, 687 bp, Homo sapiens
  misc_feature: GZ8MTXP01BI7XR.44.50.E06.1.454.CMB.2.raw
  modified_base (255)..(255): a, c, t, g, unknown or other
  misc_feature (255)..(255): n is a, c, g, or t
tcagacagtatatacacgaccggtgctcgatttagatctactgacaacacacaaggggggggtctcaggaggcagcgctctcaggacgtcaccaccatggcctgggctctgctcctcctcaccctcctcactcaggacacagggtcctgggcccagtctgccctgactcacgcctccctccgcgtccggtctggtcgtcagtcagtcacatctcctgcacgtgaaccagctaatttcattggtatcatgactatntctctggtaccagcactcaccaggcacacgccccagcgtcgtgtattttgacggtcaagttaacgccgtaccccgtcgtacgggggtcccgtacgttccgggttctacgtcggtacctacccgaacgttcgtacggacccaaacccgtcccgggtccccttccccgtagtaccccgttcgtcccgtcgggtcccttacccggacgggttacccgttacgggaacgtacgttacgggaacgggttacgttagttaacgttttaacgttaaccggttcgtacgtaaccgtccgtaccggtacgtcgggacggtactaacccgttagttagttaccgtttggtccggttttcgggacggtacgggttaccgtaggtaccttcgggttaaccgttcgtaacgtacgcgaccgtacggcctcccgttcccgtaaccg

SEQ ID NO: 339278 - DNA, 637 bp, Homo sapiens
  misc_feature: GZ8MTXP02IKG17.44.50.E06.1.454.CMB.2.raw
  modified_base (304)..(304): a, c, t, g, unknown or other
  misc_feature (304)..(304): n is a, c, g, or t
tcagacagtatatacacgaccggtgctcgatttagatctactgacaacacacaaggggggggtctcaggaggcagcgctctcaggacgtcaccaccatggcctgggctctgctcctcctcaccctcctcactcaggacacagggtcctgggcccagtctgcccctgactcagcctcccctccgcgtccggtctgtcggtcagtcagtcaccatcctcctgcactggaaccagctaatttcatttggtaatcatgactatgtctcctggtaccagcatccaccaggcacacgccccagactcgtntattttgagtacaataagccgccccgtcgacggggtcccgacgtccggttcctcgtcggtcctaccgtaacgtcgtcggaccaaaccgacccggtccccttcccgtcgtacccgtctcgtcggtctcccgaggtcgtagaccgtagtggacggctagtaatttaacgttaacgtcgtacgacgtcgtacccgagtgggacgctaacctattagtacgtttcggtcgttttcgggacgggtacgggtaacctaacggtaccgtacggtaacccgtaccgtaacggttaccgaccggtacccgtaacggtcccgtacccggtacccccgttccgg

SEQ ID NO: 339279 - DNA, 550 bp, Homo sapiens
  misc_feature: GZ8MTXP02FRUMV.44.50.E06.1.454.CMB.2.raw
  modified_base (228)..(228): a, c, t, g, unknown or other
  misc_feature (228)..(228): n is a, c, g, or t
  modified_base (439)..(439): a, c, t, g, unknown or other
  misc_feature (439)..(439): n is a, c, g, or t
tcagacagtatatacacgaccggtgctcgatttagatctactgacaacacacaagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccngcaattcattggaatcatgactatgtctctggtaccagcatcaccagcacagccccagactcgtgtattttgaggtcaaataagccgcccctgacggggtcccgatccggttctcgtcggcctccgaagtcgtcggacaacgaccgtccctcccgtgacccgtcctcgttcgggctccaggtctcgcgaatcggagctgtattatactcgnacgtctccgagtcggagcaactgtagtagttcgtcgtttcgggacggtacggaccagtacgtcgaaccgtctaacgggtcacggacccaacgtcgaccgtccccgttccgg

SEQ ID NO: 339280 - DNA, 507 bp, Homo sapiens
  misc_feature: GZ8MTXP01EJJT8.39.28.C06.1.454.CMB.2.raw
  modified_base (344)..(344): a, c, t, g, unknown or other
  misc_feature (344)..(344): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggttagcctggtatcagcaagaaaccagggaaagcccctaagctcctgatctatgctgcatccagtttgcaaagtgggtccccatcaaggttcatcggcngtgatctgggacagatttcactctcacatcagcagcctgcagcctagaagtattttgactaactttactattgtcaacaggctaacagtttcccgaggaacgttcggaccaagggaccaaagggtggaaacttcaaacgaactgtaaggctgcaaccgaattc

SEQ ID NO: 339281 - DNA, 542 bp, Homo sapiens
  misc_feature: GZ8MTXP01EDJ47.39.28.C06.1.454.CMB.2.raw
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaacgcccctaaagctcctgatctatgctgcatcctagtttgacgtaaaggttcgggtacccagtacgtaaacggttcagtcggctaggtacggatcgtagggactagtactttcactctacacatcagcanctgcacgctagagtattanactaacttatatgtacagtacgtactaacgtacgttccgaggtacgtcggacgtaaacggacgaaggtaagaaacgtacgaaacgttacgttgttggctcgaacacattcttcgttcttaac

SEQ ID NO: 339282 - DNA, 516 bp, Homo sapiens
  misc_feature: GZ8MTXP01DLGMH.39.28.C06.1.454.CMB.2.raw
tcagtcgcactagtcacgaccggtgctcgatttagagctcacgtattgggtttggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaaagctcctgatctatgctgcatccagtttgcaaagtggggtcccatcaaggttcatcggcagtggatctgggacagatttcactctcaccatcagcagccctgcagcctgaaagtattttgactaacttactattgtacaacaggctaaacgagtttccccgagggtacgttcgggaccaagggaccaaagggtggaaaatcaaacgaacgttgttgggctgcaccattctgttcttc

SEQ ID NO: 339283 - DNA, 530 bp, Homo sapiens
  misc_feature: GZ8MTXP01ECPFY.39.28.C06.1.454.CMB.2.raw
  modified_base (269)..(269): a, c, t, g, unknown or other
  misc_feature (269)..(269): n is a, c, g, or t
  modified_base (404)..(404): a, c, t, g, unknown or other
  misc_feature (404)..(404): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggtagctggtatcagcagaaccagggaaacnccctaagctcctgatctatgctgcatcctagtttgacgtaaaggttcggggtacccagtcgaaaggttcagtcggcaggtgggatcgtgggactagtatttcactctcaccatcagcagcctgcagctagaagtntttagactaacttacttattcgtacaacgtagcttaacgtacgtttccgaggtaccgttcggaccgaaagggaccaaagggtagaaatacgaaacgttacgttgaggctgcacattcttgttcttc

SEQ ID NO: 339284 - DNA, 585 bp, Homo sapiens
  misc_feature: GZ8MTXP01EOKDO.39.28.C06.1.454.CMB.2.raw
  modified_base (328)..(328): a, c, t, g, unknown or other
  misc_feature (328)..(328): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgtgacatccagatgacccagtctccatcttccgtgtctgcatctgtaggagacagagtcaccatcacttgtcgggcgagtcagggtatagcagctggtagctggtatcagcagaaaccgagggaaacgcccctaaagcctcctgatctatgctgcatccagtttgactaaaggtcgggtacccntacgtaacggttcagtcggcaggtggatcgtagggacagtacttcactctacaccatcagcagcctgcagcctagaagtattttgactaaacgttcttaattcgtacaaacgtacggtaccttaaacgtaccggtttacccggaagggtaccgttccgggaaccggaaacggggtaaccgttaaagggtaacgggttaaataaccgtaaaacgaacgttggacggtcgtcgaaccacctacttctcgtttcttaacc

SEQ ID NO: 339285 - DNA, 587 bp, Homo sapiens
  misc_feature: GZ8MTXP01A7Z7D.39.28.C06.1.454.CMB.2.raw
  modified_base (388)..(388): a, c, t, g, unknown or other
  misc_feature (388)..(388): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggtagcctggatcagcaagaaaccgagggaaacgcccctaagcctcctgatctatgctgcatccgtagtttgactaaaggtcgggtacccccatcaaggttcagtcggctaaggtgatcgtgggacagtattcactctcacntcagcagcctgcagctagaatagtttgactaacttactattcgtacaacgtacggtcttaaaccgtcgttttaccccggagggtaacccggtttaccgggaccgaaacggggaaccgtaaagggtaacgggaaaacttaacccgaaaacggtaaacgttcgggaacgggtccgtacggaccgtaaccttaacgtttccg

SEQ ID NO: 339286 - DNA, 566 bp, Homo sapiens
  misc_feature: GZ8MTXP01EB2PA.39.28.C06.1.454.CMB.2.raw
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
tcagtcgcactagtcacgaccggtgctcgatttagagctcacgtattggggtttgggggcaggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggcaagtcagggactaattaaaatgattagctggtatcagacaagaaaccaaggaaactccgtaaaggtcctagatctatgatgccttcaggtttaggaaagtggggacccagtcccgaaggttcaggcggcaaggcggntcgtagggacagtactttcacttctcacatcacngcctggcgtctagagtattcgactaactttagttactntactaaacttaatttacttcttactccgtacttccgtacgtttccgggacggtaacgggaaccttaagggtggaataacgtacgaaacgcgttggttaacggctcggcctaccttattcgttcgtttcc

SEQ ID NO: 339287 - DNA, 627 bp, Homo sapiens
  misc_feature: GZ8MTXP01BZ6NO.39.28.C06.1.454.CMB.2.raw
  modified_base (276)..(276): a, c, t, g, unknown or other
  misc_feature (276)..(276): n is a, c, g, or t
tcagtcgcactagtcacgaccggtgctcgatttagagctcacgtattgggtttgggggtcagacccagtcaggacacagcgtggacatggagggtccccgctcagctcctggggctcctgctgctctggttcccaggttccagatgcgacatccagatgacccagtctccatcttccgtgtctgcatctgtaggagacagagtcaccatcacttgtcgggcgagtcagggtatagcagcttggtagcctggtatcagcaagaaaccgagggaaacnccctaaagcctctgatctatgctgcatcctagtttgactaaaggtcgggtacccagttacgaaacggttcagtccgggctaggttgaagttcgtaggggaactaggtactttccacttctacaccatcagcagcctagcagcctagaacgtatttgacctaacgttaattattagtacaaacgtacggtacttaaacgaccggttttcccggaagggtacccgttacgggaacccgtaaacggggaacccgaaaggggtaaacggaaaactaaaccgaaaacgttaaaccggttggttacgggtaaccctaggtaacccgaaaccgtacttaccgttcgttaacctttccc

SEQ ID NO: 339288 - DNA, 571 bp, Homo sapiens
  misc_feature: GZ8MTXP01BFWS3.39.28.C06.1.454.CMB.2.raw
  modified_base (201)..(201): a, c, t, g, unknown or other
  misc_feature (201)..(201): n is a, c, g, or t
  modified_base (419)..(419): a, c, t, g, unknown or other
  misc_feature (419)..(419): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggtattagcagctggttagcctggtatcagcaagaaaccgagggaaacgcccctaagctcctgatctatgctgcatccagtttgacaaagtcggggtcccccatcaaggttcagtcggcaaggtggaatcgtaggggactagactttcactctacaccatcagcacgcctgcagcctagtaacgtntttagactaacttacttattgtacaacaggtactaacgtacgtttcccgaggtaaccgttcggaccgaaacgggaccgtaaagggtacgttaaaacgttaccgaaaacggtaacgtaggtcgggtactacggacctaacccgttaatttccg

SEQ ID NO: 339289 - DNA, 541 bp, Homo sapiens
  misc_feature: GZ8MTXP01A2D9E.39.28.C06.1.454.CMB.2.raw
  modified_base (201)..(201): a, c, t, g, unknown or other
  misc_feature (201)..(201): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcagctggtagcctggatcagcagaaaccagggaaagcccctaagctcctgatctatgctgcatccagtttgacaaagtcggggtcccccatcaaggttcagtcggcaaggtggatcgtgggacagtatttcactctcaccatcagcagcctgcagcctagaacgtatttgactaacttactattgtacaacgaggctaaactacgtttcccgaagggtaaccgttcggaccgaaacggggaccgtaaaggggtgaaaacgttcaaaacgtaactggtaacggctggactaaccgaagttcc

SEQ ID NO: 339290 - DNA, 505 bp, Homo sapiens
  misc_feature: GZ8MTXP01D6GXP.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcggcgagtcagggtattagcagctggtagctggtatcagcagaaaccagggaaagcccctaaagctcctgatctatgctgcatccagtttgcaaagtgggtccatcaaggttcatcggcagtggatcgtgggacagattcactctcaccatcagcagcctgcagcctgaagattttgctaacttactattgtactaacaggctaaacagtttcccgaggtacgttcggccaaagggaccaaagggtggaaatacgaaacgaacgttgttaggctgcacattctgttcttc

SEQ ID NO: 339291 - DNA, 575 bp, Homo sapiens
  misc_feature: GZ8MTXP01ENLLM.39.28.C06.1.454.CMB.2.raw
tcagtcgcactagtcacgaccggtgctcgatttagagctcacgtattgggtttggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaaagctcctgatctatgctgcatccagtttgcaaagtgggtcccatcaaggttcatcggcagtggatcgtgggacagtattcactctacaccatcagcagccctagcagcctagaagtattttgactaaacgttacttaattcgtacaaactaggaccttaaacgtacggttttccccgaagggtaaccgtttccgggaaccgtaaacggggaacccgttaaaggggtacggttaaaactacgaaaaacgaaccgttggttcggaactgaaccgtaccctagttctcgttcgtttaacc

SEQ ID NO: 339292 - DNA, 538 bp, Homo sapiens
  misc_feature: GZ8MTXP01ANHGS.39.28.C06.1.454.CMB.2.raw
  modified_base (409)..(409): a, c, t, g, unknown or other
  misc_feature (409)..(409): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggtatagcagctggttagcctggtatcagcaagaaaccgagggaaacgcccctaaagcctcctgatctatgctgcatcctagtttgacgtaaaggtggggtacccagtacgaaacggttcagtcggcagtgatcgtgggacagtactttcactctcacatcagcacgctgcagcctagatntttacgactaacttactattgacaagtacgctaacgacgtttccgaggtaccgttcggacgaagggaccaagggtagaaacgtacgaaacgttagttggttagctgaaccactattctcgttcttaacc

SEQ ID NO: 339293 - DNA, 567 bp, Homo sapiens
  misc_feature: GZ8MTXP01D12CD.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcggcgagtcagggtatagcagctggtagctggtatcagacaagaaaccagggaaacgccctaagctcctgatctatgctgctatcctagtttgacgtaaaggtcgggtccagtactaacggttcagtcggcaggtggatcgtagggactagtacttcactctcaccatcagcagctgcacgcgtagaagtactttagactaactttactagtttactacgtaaacacggtacctaaacgtacggtttacccggaggttaccggttaccggaccggaaagggtaccgaaagggtaggaaaacgtacgaaaccgttaagttgacggctacggctaccattcttcgttccttaac

SEQ ID NO: 339294 - DNA, 575 bp, Homo sapiens
  misc_feature: GZ8MTXP01AR2PB.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggtagcctggtatcagcaagaaaccagggaaagcccctaaagctcctgatctatgctgcatccagtttgacgaaaggtcgggtcccatcaacggttcagtcggcagtggatcgtgggacagtatttcactctcaccatcagcagcctgcagctagaagtatttgactaacgtttactagtttgtacctaaacagggtaccttaaacgtacggttttaccccgaggggtaccgtttaccgggaccgtaaaggggtacccgaaagggttacggaaaactaccgaaaaacggttacgttaggttcggctaggccaacctattcgtaagttcttaaccg

SEQ ID NO: 339295 - DNA, 580 bp, Homo sapiens
  misc_feature: GZ8MTXP01C7OSI.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggtagctggatcagcaagaaaccaggaaacgccctaagctcctgatctatgctgctatcctagtttgacgtaaaggtcggggtaccccccagtacgaaggtttcaagtcgggcaaggtggatcgtaggggacagtacttcactctcacatcagcagctgcagctagtaacgtattttacgactaaacttactattcgtacaacgtaacggtacttaaacgtacggtttacccgaagggtaaccggttacgggaccgtaaacgggaccgtaaagggtcgggaaaacttcgaaaaacggtaacgtaggtcgggtactcgacctaacgttaacgtttcg

SEQ ID NO: 339296 - DNA, 579 bp, Homo sapiens
  misc_feature: GZ8MTXP01CMEMR.39.28.C06.1.454.CMB.2.raw
  modified_base (201)..(201): a, c, t, g, unknown or other
  misc_feature (201)..(201): n is a, c, g, or t
  modified_base (275)..(275): a, c, t, g, unknown or other
  misc_feature (275)..(275): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgcgggcagtcagggtatagcagctggtagctggatcagcaagaaaccagggaaacnccctaagctcctgatctatgctgcatcctagtttgacgtaaaggtcgggtacccccatacgtaaggttcagtcgggactaaggtggatcgtagggactaggtactttcacttctaccaactatacagcacgcctagcagcctagaagttatttacgacttaaacttacgtattacgtacaacgtacggtactaacgtacgtttcccgaaggtaaccgttacggacgtaaacgggaccgtaaagggtacgaaaacgttccgaaaacgtaacgtagtcggtactaggacctaaccgttaatttccg

SEQ ID NO: 339297 - DNA, 581 bp, Homo sapiens
  misc_feature: GZ8MTXP01DTQ4X.39.28.C06.1.454.CMB.2.raw
  modified_base (184)..(184): a, c, t, g, unknown or other
  misc_feature (184)..(184): n is a, c, g, or t
  modified_base (346)..(346): a, c, t, g, unknown or other
  misc_feature (346)..(346): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgngtctgcatctgtaggagacagagtcaccatcacttgtcggcagtcagggtatagcagctggttagctggatcagcaagaaaccaggaaacgcccctaagctcctgatctatgctgcatccagtttgacaaagtcgggtacccccatacaaggttcatccggnaagtgatcgtgggacagtatttcactctcacatcagcagctgcagctagaagtattttgactaactttactattgtacaaacaaggtcttaaacgtacggttttaccccgaagggtaaccggtttcgggaccgtaaacggggaaacccgaaaggggttaaccgggaaaaattaccgaaaaacggtaaaccgtaggttaacgggcttacgggaccctaaacccgttaagtttcccg

SEQ ID NO: 339298 - DNA, 569 bp, Homo sapiens
  misc_feature: GZ8MTXP01EDCX5.39.28.C06.1.454.CMB.2.raw
  modified_base (283)..(283): a, c, t, g, unknown or other
  misc_feature (283)..(283): n is a, c, g, or t
  modified_base (426)..(426): a, c, t, g, unknown or other
  misc_feature (426)..(426): n is a, c, g, or t
tcagtcgcactagtcacgaccggtgctcgatttagagctcacgtattggggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcaggggttattagcagcttgggttagcctggtatcagacaagaaaccagggaaacnccctaagcctctgatctatgctgcatcctagtttgacgtaaaggtcgggtacccagtacgtaacggttcagtcggactaggtgatcgtagggactagtacttcactctacacatcagcacgcctgacagtcctagtaacgttntttacgaccttaacgtttacttattacgaacaaacgtacggaccttaaacgtacgtttaccggaggtaccgttacggacgaaagggacaagggtacgaaatacgaaagacgttggacgctcgaactacattctcgttctaacc

SEQ ID NO: 339299 - DNA, 712 bp, Homo sapiens
  misc_feature: GZ8MTXP01EWAGB.39.28.C06.1.454.CMB.2.raw
  modified_base (236)..(236): a, c, t, g, unknown or other
  misc_feature (236)..(236): n is a, c, g, or t
  modified_base (640)..(640): a, c, t, g, unknown or other
  misc_feature (640)..(640): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatctccgtgtctgcatctgaagagacagagtcaccattcacttgtcgggcgagtcagggtnttagcagctggttagcctggatcagcagaaaccaggtaaagcccctaagctacctgatctctagtcgtctcgtactacgttaccgtacggttacggtaaccggtaaaccggtaccgggtaccgtacgtacgtaacggttaacgtacgtcggtacgtaggtagggtacgtacgtacgggtacgatttactttaacctaacccttactacccaaccgtactacgaccgacgaccgtaccgtccgtacgaaccgtaccgttaaggggactacgtttacgtaacttaaccgtttaaaccttaacgttacgtaacctaaaccgtaacggtaacccgtaaacggttaacccggtttaacccgggtaacgggttaaccggggtacccggttaaccgggtaaaccgggtaanccggttaaacggggttaaacggtaacgtaacgtaaaccgtaacggtacggttaccggtaacgttcgtaaccg

SEQ ID NO: 339300 - DNA, 562 bp, Homo sapiens
  misc_feature: GZ8MTXP01BBKXH.39.28.C06.1.454.CMB.2.raw
  modified_base (273)..(273): a, c, t, g, unknown or other
  misc_feature (273)..(273): n is a, c, g, or t
  modified_base (536)..(536): a, c, t, g, unknown or other
  misc_feature (536)..(536): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggtattagcagctggtagctggtatcagcagaaaccagggaaacncccctaaagctcctgatctatgctgcatcctagtttgacgaaaggtcgggtacccagtcgtaacggttcagtcggcaggtggactcgtgggacagtattcactctacaccatcagcacgcctgcagcctagaagttatttgacttaacgttacttattacgtacaaacgtacggtacttaaacgtacggtttacccggagggtaccgttcggaccgaaacgggaccgaaagggtacgaaagtacgaaacgacgttggttacgntcgaacaccgattctcgttcttaacc

SEQ ID NO: 339301 - DNA, 587 bp, Homo sapiens
  misc_feature: GZ8MTXP01C5CIC.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggttattagcagctggttagcctggtatcagcaagaaaccgaggaaacgccctaagctctgatctatgctgcatccgtagtttcgacgtaaaggtcggggtacccccatacgtaaggttcagtcgggactaaggtggtacgtcgtaggggaactagtactttacactctaccacatcacgacacgtcctggacacgtcctagtaagttatttacgacttaaacttacttaattcgtacaacgacgtactaaccgtcgttaccggaggtaaccgtacggacgtaaagggacgtaaagggtacgaaaacgttcgaaaacggtaactggtcgcgtacgactaaccttaagtttccg

SEQ ID NO: 339302 - DNA, 559 bp, Homo sapiens
  misc_feature: GZ8MTXP01CWL16.39.28.C06.1.454.CMB.2.raw
  modified_base (529)..(529): a, c, t, g, unknown or other
  misc_feature (529)..(529): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcgagtcgagggtatagcagtctggtagctggtatcagacaagaaaccgagggaaacgccctaaagcctcctgatctatgctgcatcctagtttgacgtaaaggtcgggtacccagtcgtaacggttcagtcggactaggtaggatcggtagggactaggtacttcacttcacacctatcgagcacgcctgacagcctagaagttacttagactaacgttactagttacgacaaacgtagacttaacgtacgttaccgtaggtacgtcggaccgaaagggacgaaacggtagaaacgtaacgaaacgttagngttacggcacgcacgtattctgttcttaac

SEQ ID NO: 339303 - DNA, 660 bp, Homo sapiens
  misc_feature: GZ8MTXP01DDA79.39.28.C06.1.454.CMB.2.raw
  modified_base (414)..(414): a, c, t, g, unknown or other
  misc_feature (414)..(414): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatcgacccagtctccattccttccgtgtctgctatcgtgtaggagacagatcaccatcacgttggtcgggcgagtcgagggttatagcagtcgtggttagctggtatcagacaagaaaccgaaggaaaccgccctaagcctccgtagatctatgctgctatccgtagtttcgacgtaaggtcgggtacccccagtacgtaaggttccagtccggactggtgagtcgtagggacagttcttacacttcacaacntacaggcacgcctagaccacgtaccgtagtaacgtttactttacgtaacccttaaactttacgtttagtttacgtaaaccgtaacgtaaacgttacccgttaaacgttaccggtttaccccgggtaagggttaacccggttacccgggaacggaaacgggttaacccgtaaaagggtacgttaaaaaacgttccgaaaaacggtaagttaccggtgggtactacggacctaaccgttctttaaccg

SEQ ID NO: 339304 - DNA, 710 bp, Homo sapiens
  misc_feature: GZ8MTXP01CTWW3.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgagggttattagcagcttggttagtctggatcagacaagaaaccaggaaactcgtaaggtcctgatctagtgatcgccttcgtaaggtttagggaaaggttcgggggtacccagttacgaaacgggtttcgaggcggacgtaggtagggacttcggtagggggtaaactaagggttactttaccacctttccgtaccctaaccctacttacccaacccgtacggtcccgtcgggaccggtaccgttaaggtaaacggttacttttacgaacttaaacttttactttaccgttacgttaacctaaaactttaaattttaactttaccttaactcccgtacttaccgttaccgtttccggggacggtaaggggaacccgtaaaggggttcggtaagaacgttaaaccgtaaaacggttaacgttcgggttacggccgtacggtaacctacccgtatttccgttcgtttccgtttaacccg

SEQ ID NO: 339305 - DNA, 557 bp, Homo sapiens
  misc_feature: GZ8MTXP01A5UIA.39.28.C06.1.454.CMB.2.raw
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcattgtcgggcagtcagggtattagcagctggttagcctggtatcagcaagaaaccgagggaaacgcccctaagctcctgatctatgctgcatcctagtttgacaaaggtcggggtcccccatcaaggttcatcggcngtgatcgtagggactagtatttcactctcaccatcagcacgcctgcancctagtaagtagttttgactaacttacttattcgtacaaacaggtacctaaaccgtacggttccccggaagggtaaccgttcggaccgtaaacggggaccgtaaagggtagttaaaacgttcgaaacgaacttggaacgctagcctaaccgttgtcg

SEQ ID NO: 339306 - DNA, 538 bp, Homo sapiens
  misc_feature: GZ8MTXP01DKDE9.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggtagcctggatcagcaagaaaccaggtaaacgcccctaagctcctgatctatgctgcatccagtttgacaaaggtcgggtcccccagtcaaggttcagtcggcaagtggatcgtagggacagtactttcactctcaccatcagcagcctgcagctagaagtattttgactaaactttactattcgtacaacacggtactaactacgtttaccgaggtaaccgttcgaccgaaagggaccgaaaggtaggaaaattcaaaacgtaacgtgtgggcctgacctaaccaattcg

SEQ ID NO: 339307 - DNA, 598 bp, Homo sapiens
  misc_feature: GZ8MTXP01BAIC4.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcgagtcagggtattagcagctggtagcctggtatcgagcaagaaaccgagggaaacgcccctaagctcctgatctatgctgctatccagtttagacgtaaaggtcggggtacccccagtacgtaaaggttcagttaacggcgtaaggtcgggtaattcgtaggggaactaggtactttccaacttctaccacctatacagtccagtcctggcacgctagtaatagttttcgacttaacttacttattcgtacaacgtacggtacttaacgtacgtttacccggaaggtaaccggttacggaccgtaaagggaaccgtaaagggtaacgaaagttcgaaaacgtaagtggtaagctagacctaacttaacgttcg

SEQ ID NO: 339308 - DNA, 682 bp, Homo sapiens
  misc_feature: GZ8MTXP01DGEK5.39.28.C06.1.454.CMB.2.raw
  modified_base (237)..(237): a, c, t, g, unknown or other
  misc_feature (237)..(237): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgaggtattagnagtcgttaggtacgccgtggtactcgagacaaagaaaccgagggaaacctcccgtaagcctacgtgactctatgctgactactcgtagtttacgaacgtaaggtccggtaccagtacgtaacggttcaggtcgacgtaggtacggacttcgggtagggaactagtttacttcgacttctaccacctatcaacgcacgtccgtagaccgtaacgtccgtaagtaacgtttactttacgaaccctttaaactttaacgttagtttacgaaccgtaaacggtaccgttacttaaaccggtttaccggttaccgggtacggttaacccggtccgggaaacccggtaaacgggtaaccgttaaagggttaaacgaaacttaaaccggaacgttaacggttcgttacggtctaccgaacctaacgtcgttacctttcgttcctttaacccg

SEQ ID NO: 339309 - DNA, 543 bp, Homo sapiens
  misc_feature: GZ8MTXP01AOVXE.39.28.C06.1.454.CMB.2.raw
  modified_base (274)..(274): a, c, t, g, unknown or other
  misc_feature (274)..(274): n is a, c, g, or t
  modified_base (351)..(351): a, c, t, g, unknown or other
  misc_feature (351)..(351): n is a, c, g, or t
  modified_base (417)..(417): a, c, t, g, unknown or other
  misc_feature (417)..(417): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtatagcagctggtagctggatcagcagaaaccgaggaaacncccctaagctcctgatctatgctgctatccgagtttcgacgtaaaggtcgggtaccccatcgaaggttcagtcggcnggtgactcgtagggactagtactttcactctacaccatcagcacgctagcacgtcctagtaacttntttagaccttaacttactattcacaagtacggcttaacgtcgtttccgaggtaacgttcggacgtaaggaccgaaggtacgaaagttcgaaccgtaatgtaacgacgtcactaaccgttaattccg

SEQ ID NO: 339310 - DNA, 581 bp, Homo sapiens
  misc_feature: GZ8MTXP01AV0TS.39.28.C06.1.454.CMB.2.raw
  modified_base (280)..(280): a, c, t, g, unknown or other
  misc_feature (280)..(280): n is a, c, g, or t
  modified_base (429)..(429): a, c, t, g, unknown or other
  misc_feature (429)..(429): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggtatagcagctggtagcctggatcagcaagaaaccgagggaaacncccctaagctcctgatctatgctgctatccgtagtttgacgtaaaggtcgggtacccccagtacgaaggttcagtcgggctggtggactcggagggactagtactttcactctacaccatccagcacgcctagcagctagtaaacgttnttttacgacttaaactttactagttcgactaaacgtacggtaccttaaacggtacgtttacccggaaggttaaccgttacggaaccgaaagggaccgtaaagggtaagaaacttcgaaaccgtaagtgtcggctacggacctaacttgttcc

SEQ ID NO: 339311 - DNA, 617 bp, Homo sapiens
  misc_feature: GZ8MTXP01CKUNI.39.28.C06.1.454.CMB.2.raw
  modified_base (281)..(281): a, c, t, g, unknown or other
  misc_feature (281)..(281): n is a, c, g, or t
  modified_base (448)..(448): a, c, t, g, unknown or other
  misc_feature (448)..(448): n is a, c, g, or t
tcagtcgcactagtcacgaccggtgctcgatttagagctcacgtattggggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagagtcaccatcacgttggtcgggcgagtcaggggtattagcagtctggtagcctggtatcagcaagaaaccgagggaaacncccctaaagcctcctgatctatgctgctatcctaggtttgacgtaaaggttcgggtacccagtacgtaaacggttcagtcggactaggtacggatcggtagggtaactaggttactttccaactctaccacccatcagcacgcctaggcacgtccgtagaaacgttntttacgacttaaacgtttactagttcgaacaacgtagtaccttaaacgtacggtttaccggaggtaccggttacggaacgaaacggggtaaccttaaaggggtaacgaaacgtaacgaaacggttacgttggcggtaacctagcccacgtacttcttcgttccttaacg

SEQ ID NO: 339312 - DNA, 604 bp, Homo sapiens
  misc_feature: GZ8MTXP01AH0WV.39.28.C06.1.454.CMB.2.raw
  modified_base (288)..(288): a, c, t, g, unknown or other
  misc_feature (288)..(288): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagagtcaaccatcacgttggtcgggcgagtcgaggggttattagcagtcgtggttagccgttggtatcagacaagaaaccgagggaaacnccccgtaagctctgatctatgctgctactctagtttgacgtaaaggtcgggtacccagtacgtaacggttcagtcggacaggtagatcgagggaactagtactttcactctacacatcgagcgacgcgtagacacgtctaagtaacgttactttacgaacttaacgtttaacttagttacgaacgtaaacgagtaccttaacgttacggttacccgagggtaccgtacggaccggaaaggtaacgaagggtaacgaaacgtaacgaaacgttcgttggttcgaagtcgaacctactacgttcttcgttccttaacg

SEQ ID NO: 339313 - DNA, 639 bp, Homo sapiens
  misc_feature: GZ8MTXP01BW9IV.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggatcagcaagaaaccaggaaacgcccctaagctcctgatctatgctgcatccagtttgacgaaaggtcggggtccccccagtcgaaggttcagtaccgggctaaggtggaagttcgtaggggaactaggtactttccacttctacaccatccaggcagcctgcacgcctagtaaacgttatttgaccttaaactttactattacgtacaacgtaaggtaccttaaacgtacggttttaccccggagggtaacccgtttcggggaccgtaaacgggggaacccgtaaagggggttaacggttaaaaacgttaccggttaaaaaccggtaaacggtttggggtaaccgggtcctacgggttaccctaaccgttaacttttcccgg

SEQ ID NO: 339314 - DNA, 586 bp, Homo sapiens
  misc_feature: GZ8MTXP01ET9JQ.39.28.C06.1.454.CMB.2.raw
tcagtcgcactagtcacgaccggtgctcgatttagagctcacgtattgggtttgggggtcagacccagtcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagctggtatcagcaagaaaccagggaaaactcgtaaggtcctgatctatgactgacctccgtagtttagggaaaggtcgggggtaccctagtcgtaaaggttcacggtcggacgaggtggatcgtagggctagtacttcactctcacactcacagctgcgctagtagtatttcgactaacttatactagtactaaacttaattttaattcttaactcccgtcttacgtacgtttcggacggtacgggaccaagggtaaggtaagaacgttaacgaaacgtaacgttggttaggttccttaggcctaccgtaattccgtcgttacctttcgaacctttccccg

SEQ ID NO: 339315 - DNA, 609 bp, Homo sapiens
  misc_feature: GZ8MTXP01BACFY.39.28.C06.1.454.CMB.2.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (573)..(573): a, c, t, g, unknown or other
  misc_feature (573)..(573): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccagattccagatgcgacatccagatgacccagtctccatcttccgtgtctgcatctggtagganacagagtcaccatctacgttggtcgggcgagtcgaggggttattagcagcgtggttagcgtgtatcagcaagaaacgaggaaacncccctaagctcctgtatctatcgctgctatccgtagtttcgacgaaacggtccggggtccctagtacgtaacggttcaaacgttcgggcgtaggtgggtacgttcgtaggggtaactagttaactttccacttcctaccactactacacggtcacgtcctacgcacgtccgtagtaacggttacttttacgacttaactttactattacgtacaacgtacgtactaacgtacggttccggaacggtcggttacgggaccgaaacgggacgtaaagggttacgaaanaacgaaacgtacgtgtcgggcttacggcttcgtaac

SEQ ID NO: 339316 - DNA, 598 bp, Homo sapiens
  misc_feature: GZ8MTXP01D32DM.39.28.C06.1.454.CMB.2.raw
  modified_base (390)..(390): a, c, t, g, unknown or other
  misc_feature (390)..(390): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagagtcaccatcacttggcgggcgagtcgagggtattagcagcttggtagcctggtatcagacaaggaaaccagggaaacgcccctaaagcctcctgatctatgctgcatctagtttgacgtaaaggtcgggtacctagtactaaggttcagtcggctaggtagatcgaggactagtacttcactctacacntcagcagctgctacgctagtaagttactttacgaaccttaactttaacttagttacgtaacctaaacgaacggtaccttaaacgttaccggtttaccggaacggtaccggttaccggaccggtaaacgggtaaccgaaagggtaacggaaagtaaaccgaaaggttaacgttggttacgctcgaacctactattctcgttccttaacc

SEQ ID NO: 339317 - DNA, 557 bp, Homo sapiens
  misc_feature: GZ8MTXP01ELWW0.39.28.C06.1.454.CMB.2.raw
  modified_base (481)..(481): a, c, t, g, unknown or other
  misc_feature (481)..(481): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcaagaaaccgagggaaacgcccctaagctcctgatctatgctgcatcctagtttgacgtaaaggtcggggtaccccccagtacgtaaaggttcaagtccgggactaaggtgggtaatccgtaggggactaggtactttcactctacacatcagcagcctgcacgcctagaacgtattttggactagttactatcacttgtcagtctagtatgggtaancttacgaaacgttcgttacggaaccgaagggttaccaagggtaacggaaataacgaaacgacttggtcggctaacg

SEQ ID NO: 339318 - DNA, 622 bp, Homo sapiens
  misc_feature: GZ8MTXP01BZGT1.39.28.C06.1.454.CMB.2.raw
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatcgacccagtctccattcttccgtgtctgctatctgtaggagacagagtcaccatcacgttggcgggcgagtcgagggtatagcagtcgtggttagctggatcagacaagaaaccgagggaacncccctaagcctctgatctatnctgctactctagttagacgtaaacggtcgggtaccccagtacgtaagttcacgtcggacgtggtggtactcggtacgggactagtactttcaccttctaccacgtactccgagcctacgtcctacgaccgtacgtccgttaagtaacgttacgtttacgtaaccttaaactttacttaagttacgtaacaacgtaacgtacttaaccgtacggttcccggaacggtaaccgttacgggaacgtaaacggggaacgtaaacgggtaacgaaacgttacgaaacgtaagtcgtcggctacgacctaacgttcttccg

SEQ ID NO: 339319 - DNA, 599 bp, Homo sapiens
  misc_feature: GZ8MTXP01A7K89.39.28.C06.1.454.CMB.2.raw
  modified_base (282)..(282): a, c, t, g, unknown or other
  misc_feature (282)..(282): n is a, c, g, or t
  modified_base (428)..(428): a, c, t, g, unknown or other
  misc_feature (428)..(428): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcgagggtattagcagcgttggtagcctggtatcagacaaggaaaccgagggaaacnccctaagcctctgatctatgctgctatccagtttgacgtaaaggttcgggtaccatacgtaacggttcagtcggataggtggatcgagggtactagtactttcgactctaccactatcagcacgcctagacaggcctagtaagttntttacgaacttaacgtttattagttactacgaacgtacgtactaacgtacggttcccgaaggtaccgtacgggaaccgtaagggaaccgaaagggtacgttaaagtaacgaaacgttacgttggttacggtaactcggaactaccgtattccgttaacgttcctttaaccg

SEQ ID NO: 339320 - DNA, 566 bp, Homo sapiens
  misc_feature: GZ8MTXP01E1MYA.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagagacagagtcaccatcacttgtcgggcgagtcagggtatagcagctggttagcctggtatcagcagaaaccagggaaacgcccctaagctcctgatctatgctgcatccagtttgacaaaggtcgggtcccatcaacggttcagtcggcagtggatcgtgggacagtatttcactctacaccatcacgcagccctgcagcctagaactattttgactaaacgttactattcgtacaaacaggtcctaaactacggtttaccccgagggtaccgtacgggacccgaaaggggaacccaaagggtacgggttaaaactaccgaaaacgaaccgttggttacggctcggccaacccacttccttcgttaaccttccg

SEQ ID NO: 339321 - DNA, 654 bp, Homo sapiens
  misc_feature: GZ8MTXP01EK089.39.28.C06.1.454.CMB.2.raw
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccattcttccgtgtctgcatctgtaggananagagtcacatcacgttggtcgggngagtcaaggggtattagcagcgttggttagccgttggtatcagacaagaaaccgaagggaaacgtccccgtaaagcctcctgatctatgctgctatctagtttagacgtaaaggtcgggtacccatacgtaagttcagtcggcaggtaggatcgtagggaactgtatttccgactctacactatacgagcacggcctacggactacgccgtagtaacgttagttttacgaacttaaacgtttacttagtttacgtaacgtaaaccgtacggtaaccgttaaaccgtaacgggtttacccggtaagggttaacccgggttaccggaaccggtaaaacggggtaccgttaaaggggaacgttaaaacgtaccgaaaaacgttcgttcggttacgggaactaggaacgtaccctagttccttaagttccttaacc

SEQ ID NO: 339322 - DNA, 601 bp, Homo sapiens
  misc_feature: GZ8MTXP01CCWGS.39.28.C06.1.454.CMB.2.raw
  modified_base (273)..(273): a, c, t, g, unknown or other
  misc_feature (273)..(273): n is a, c, g, or t
  modified_base (391)..(391): a, c, t, g, unknown or other
  misc_feature (391)..(391): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggttagcctggtatcagcaagaaaccagggaaacncccctaagcctcctgatctatgctgcatccagtttgacgtaaaggtcgggtacccatcgtaacggttcagtcggcaggtgatcgtgggactagtattcactctcacatcagcagtccngcagcctagagtatttacgacttaactttactatttacgactaaacgtggtaccttaacgtaccggtttacccggaagggttaccggttccgggaacccgtaaacggggtaaccgttaaaggggtacgaaaacgttaacgaaaacgttaaccgttgggttacggtccgtacggaacctaaccgtacgttcttaacggttcctttaacccg

SEQ ID NO: 339323 - DNA, 605 bp, Homo sapiens
  misc_feature: GZ8MTXP01C8TY2.39.28.C06.1.454.CMB.2.raw
  modified_base (201)..(201): a, c, t, g, unknown or other
  misc_feature (201)..(201): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacgttggtcgggcgagtcgagggttattagcagctggttagctggatcagcaagaaaccaggaaacgccctaagcctctgatctatgctgctatccgtagtttgacgtaaaggtcggggtaccccagtacgaggttcagtcggcaaggtggtacgtcgtagggaactagtattccgacttctacctaccagtccgacgacgacgtcgtacgacgacgtcgtaagtatttaggttactaactttaacttacgtagttacgtaacgacgtaactacgttaacgttacggtaccgaggtaaccgtacggaaaccggtaaacgaaacggtaaggtaacgttaaacgttaacgttaaacgtcgttagcgtctacgttacctaacttaacgtttcg

SEQ ID NO: 339324 - DNA, 774 bp, Homo sapiens
  misc_feature: GZ8MTXP01BP529.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcagtcagggtattagcagctggtagctggatcagcaagaaaccgaggaacgcccctaagctcctgatctatgactgcatccagtttgacgtaaaggtcggggtaccccccagtcgaagggtttccagttcccggggactaaggtcgggacgttaccgtagggggtactaaggtacttttcccaacctttcctaccaaaccctaacgtccaacggcccgaacggtccccttaggcccgaacggtaccccgttaagggttaaaacggttagtttttttaccggaaacctttaaaccgttttaaacctttaacgtttaccggttaaaccaaaaccggtaaacggggttaacccttaaaaccgggttaaccgggttttccccccggggaaaaggggttaaccccgggtttaaccggggaaacccgggaaaaccgggggttaaccgtaaaaacgggggtttaacggaaaaaaccgttacccgaaaaaaccgggttaaaccggttggggttaacgggaacccgttcggaacccttaacccttaacggtttcccg

SEQ ID NO: 339325 - DNA, 567 bp, Homo sapiens
  misc_feature: GZ8MTXP01C0OTE.39.28.C06.1.454.CMB.2.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
  modified_base (542)..(542): a, c, t, g, unknown or other
  misc_feature (542)..(542): n is a, c, g, or t
  modified_base (550)..(550): a, c, t, g, unknown or other
  misc_feature (550)..(550): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttggcgggcgagtcagggtatagcagctggtagctggatcagcaagaaaccgaggaaacnccctaagcctcctgactctatgctgctatcctagtttcgacgtaaaggtcgggtacccccagtacgtaaggttcacgtacgggactaaggtggattcggtaggggacagttactttcacttctaccacatcgagcagcctgacacgctagtaagttactttcgacttaacgttactattcgtacaacgtacgtactaaacgtccgttaccgaggtaaccggtacggaccgaaagggacctaaaggtagaaacttcgaaacgtcgnggtaacgntacgctaacgttgttcg

SEQ ID NO: 339326 - DNA, 720 bp, Homo sapiens
  misc_feature: GZ8MTXP01BOKPR.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatcgacccagtcctccattccttccgtgtctgcatctggtaggagacagagtccacctatcacgttggcgggcgagtcgtagggtattgcagtcgtggttagccgtggtatcagaccaaaggaaacccggaagggaaaccgcccctaagcctccgtgtactctagtgctgccacttcgtagtttacgacgtaaacggtcgggtaccccctaagtacgtaaggttcaacgtcggacgtaaggtgggtacgtacggtagggtactaacggtacttttacccacctttacctaccctaacctattaccgagacccgtaacggtcccgtagccgtaacgtccgtaaagttaaccggtttagttttacgtaaccttaaactttaacggttacttaccgtaacgtaaaccgtacgtaaaccgtaaccgttaccggtttacccgggaaacgggttaacccggttaccgggaacgaaaccggggttaaacgtaaacgggtaacggttaaaagttaccgttaaaacgtaacggttggaacggttacgcgactaacgttcgtttaaccg

SEQ ID NO: 339327 - DNA, 547 bp, Homo sapiens
  misc_feature: GZ8MTXP01B4LQ5.39.28.C06.1.454.CMB.2.raw
  modified_base (274)..(274): a, c, t, g, unknown or other
  misc_feature (274)..(274): n is a, c, g, or t
  modified_base (405)..(405): a, c, t, g, unknown or other
  misc_feature (405)..(405): n is a, c, g, or t
  modified_base (441)..(441): a, c, t, g, unknown or other
  misc_feature (441)..(441): n is a, c, g, or t
  modified_base (535)..(535): a, c, t, g, unknown or other
  misc_feature (535)..(535): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcagggtatagcagctggtagctggtatcagcaagaaaccagggaaacnccctaagcctcctgatctatgctgcatcctagtttgacgtaaaggtcgggtcccagtacgaacggttcagtcggctaggtggactcggtagggactagtactttcactctcacctatcagtcagcctgcanctagaagtatttgactaacttacttattcacaacgngtacctacgtacgttccgaggtaccgttcggaacgaacgggaccttaagggtacgaaacgtacgaaacgacgttggttcgcgtcgaacaccgtnttcgtcgttctc

SEQ ID NO: 339328 - DNA, 584 bp, Homo sapiens
  misc_feature: GZ8MTXP01A8FKA.39.28.C06.1.454.CMB.2.raw
  modified_base (301)..(301): a, c, t, g, unknown or other
  misc_feature (301)..(301): n is a, c, g, or t
  modified_base (441)..(441): a, c, t, g, unknown or other
  misc_feature (441)..(441): n is a, c, g, or t
tcagtcgcactagtcacgaccggtgctcgatttagagctcacgtattgggtttgggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagcttggtccagccggggggtccctgagactctcctgtgcagcctctggattcacctcagcagctatgccatgacctgggtccnccaggctccgagggggaagggctgggagtgggtctcgtctattacgtggagtggtgcttaatacaactacgcagcctcgtgaacgggcccgcttcaccagtctccagagactattccaagagacactctaggtatcctanactaaatacgaacacgcgtagtacggtcgacccggaaggaaccgaaccggttacccttaattaacgtttacgttggttcggaacggttaaggtggggtaggggggtaagggtcgggggtacgttaccgtcggttcgggttccg

SEQ ID NO: 339329 - DNA, 611 bp, Homo sapiens
  misc_feature: GZ8MTXP01CEQVE.39.28.C06.1.454.CMB.2.raw
  modified_base (186)..(186): a, c, t, g, unknown or other
  misc_feature (186)..(186): n is a, c, g, or t
  modified_base (288)..(288): a, c, t, g, unknown or other
  misc_feature (288)..(288): n is a, c, g, or t
  modified_base (400)..(400): a, c, t, g, unknown or other
  misc_feature (400)..(400): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccattcttccgtntctgcatctgtaggagacagagtcaccatcactttggtcgggcgagtcgaggggttattagcagtcgtggttacgcctggatcagacagaaaccgaggaacnccctagctctgatctagtgctgcatcctagtttgacgtaaggtcgggtaccccagtcgtaagttcagtcggacgtggtggtatcgtagggactagtacttcactctaccacntacacgcacgtcctgaccgacgtccgtagtaacgtttacttttacggaaccttaaacgtttacttaacgttacgtaacctaaacggtacggtaacttaaaccggtaccggtttacccggaacggttaaccggttacggaccgaaacgggttaccgtaaagggtacgaaacgttacgaaacgtaagtggcggactcgacctaacgttcgtcg

SEQ ID NO: 339330 - DNA, 607 bp, Homo sapiens
  misc_feature: GZ8MTXP01B9FZI.39.28.C06.1.454.CMB.2.raw
  modified_base (299)..(299): a, c, t, g, unknown or other
  misc_feature (299)..(299): n is a, c, g, or t
  modified_base (375)..(375): a, c, t, g, unknown or other
  misc_feature (375)..(375): n is a, c, g, or t
  modified_base (595)..(595): a, c, t, g, unknown or other
  misc_feature (595)..(595): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatcgacccagtctccattccttccgtgtctgcatctggtaggagacagagtccaaccatccacgtttggtcgggcgagtcgaggggtattagcagtcgtggttagccgtaggtatcgagacaagaaaccgagggaacncccctaagctctagatctatgctgctatccgtagtttgaactaaggtcggtaccccagtacaaggttcagtcgacnggtgatcgtagggactagtacttcactctacacatacacgacacgctagccagtaccgtaagtaagttacttttacgaacttaactttacgttattcgtaacaaacgtacggtaacttaacgttccggtttacccgaagggtaacccggttacggaacggaaacgggaacgtaaagggtagaaaacgttcgaaaacgtaacgttggaacggtcagttacnccgttaagttcc

SEQ ID NO: 339331 - DNA, 580 bp, Homo sapiens
  misc_feature: GZ8MTXP01BCMQY.39.28.C06.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (362)..(362): a, c, t, g, unknown or other
  misc_feature (362)..(362): n is a, c, g, or t
  modified_base (558)..(558): a, c, t, g, unknown or other
  misc_feature (558)..(558): n is a, c, g, or t
  modified_base (568)..(568): a, c, t, g, unknown or other
  misc_feature (568)..(568): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacgttggtcgggcgagtcgaggggtattagcaggtcttgggttagcctggtatcagacagaaaccgagggaaacncccctaaagctcctagatctatgctgcatcctagtttgacgtaaaggtcgggtaccagtcgtaacggttcagtccggnaggtgaagtcgtagggactagtacttcactctacaccatacgagtcacgtcctagcacgtacctaggtaagttactttagaccttaaactttctattcgaacaagcgtactaacgtcgtttacccggaggtaccggttcggaacgaaagggacccgaagggtacgaaacgtaacgaaacgttacgttggttacggntcgaacactnttcctgttcctc

SEQ ID NO: 339332 - DNA, 527 bp, Homo sapiens
  misc_feature: GZ8MTXP01BF8DF.39.28.C06.1.454.CMB.2.raw
  modified_base (201)..(201): a, c, t, g, unknown or other
  misc_feature (201)..(201): n is a, c, g, or t
  modified_base (402)..(402): a, c, t, g, unknown or other
  misc_feature (402)..(402): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgcgggcagtcagggtattagcagctggttagcctggatcagcagaaaaccagggaaagcccctaaagctcctgatctatgctgcatccagtttgcaaagtggggtcccccatcaaaggttcaatacggcaagtggatctggggaacagatttcactctcgaccatcagacagcctgcagtccnaagtatttcggctaaattactaatgtcaaacaggtacaacgagtttcccgaaggaacgtggttaccaaagggaccgaaaggtggaaaacgacaaacgaactagtcgcgtcgactaacgaacgtcg

SEQ ID NO: 339333 - DNA, 518 bp, Homo sapiens
  misc_feature: GZ8MTXP02JZDM7.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcatcggcagtgatcgtgggacagatttcactctcaccatcagcagcctgcagcctgaagtattttgctaaacttactattgtacaacaggactaaacacgtttcccgaggtaccgttcggaccaaacggggaccaagggtacggaaactacgaaaacgaactgtaggctgacaccgatctcgtcttc

SEQ ID NO: 339334 - DNA, 519 bp, Homo sapiens
  misc_feature: GZ8MTXP02F4ZR8.39.28.C06.1.454.CMB.2.raw
  modified_base (346)..(346): a, c, t, g, unknown or other
  misc_feature (346)..(346): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagtagacagagtcaccatcacttgtcgggcagtcagggtattagcagctggtagcctggtatcagcagaaaccagggaaacgcccctaagctcctgatctatgctgcatccagtttgcaaagtcggggtccccatcaaggttcatcggcngtggatcgtgggacagatttcactctcaccatcagcagcctgcagcctagaatattttgactaactttactattcgtacaaacaggactaacgacgtttcccgaggtaccgttcggaccgaaggaccaaggtacggaaaactcgaaaacgaacgtggtacgctagacaccatc

SEQ ID NO: 339335 - DNA, 519 bp, Homo sapiens
  misc_feature: GZ8MTXP02GXZNS.39.28.C06.1.454.CMB.2.raw
tcagtcgcactagtcacgaccggtgctcgatttagagctcacgtattgggtttggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaagcccctaagctcctgatctatgctgcatccagtttgcaaagtggggtcccccatcaaggttcatcggcagtggatctgggacagatttcactctcaccatcagcagcctagcagcctagaagtattttgctaaactttactaattcgtacaacaggactaacagtttcccgaggtaccgttcggaccaaagggaccaaaggtaggaaaactacgaaaacgaactgtacggctagacaccattcg

SEQ ID NO: 339336 - DNA, 509 bp, Homo sapiens
  misc_feature: GZ8MTXP02GLIXS.39.28.C06.1.454.CMB.2.raw
  modified_base (279)..(279): a, c, t, g, unknown or other
  misc_feature (279)..(279): n is a, c, g, or t
  modified_base (347)..(347): a, c, t, g, unknown or other
  misc_feature (347)..(347): n is a, c, g, or t
  modified_base (425)..(425): a, c, t, g, unknown or other
  misc_feature (425)..(425): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaancccctaagctcctgatctatgctgcatccagtttgacaaagtgggtcccccatcaaggttcatcggcngtgatcgtgggacagatttcactctcaccatcagcagcctgcagcctagaagtatttgctaacttactattgtacaanagctaacagttcccgaggtacgttcggacgtaacgggaccaaggtagaaactacgaaaacgaacgtgacggactgacaccatcg

SEQ ID NO: 339337 - DNA, 586 bp, Homo sapiens
  misc_feature: GZ8MTXP02H9NGE.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtattagcagctggttagcctggtatcagcaagaaaccgagggaaacgcccctaagctcctgatctatgctgcatccagtttgacaaaggtcggggtacccatcaacggttcagtcggcaggtggatcgtgggacagtatttcactctcaccatcagcagccctgcagcctagacgttatttacgacttaaacttacttattagtacaaacgtaggaccttaaacgtacgtttacccggaaggtaccgttacgggaaccgaaacggggtaacccgtaaggggtaaacgtaaaacgttaaccgaaaacggtacgtttaggcgggtaacctggacccacctagtttcctacgtttacttccg

SEQ ID NO: 339338 - DNA, 555 bp, Homo sapiens
  misc_feature: GZ8MTXP02ITKYT.39.28.C06.1.454.CMB.2.raw
tcagtcgcactagtcacgaccggtgctcgatttagagctcacgtattgggtttggggtcagacccagtcaggacacagcgtggacatgagggtcccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctatgctgcatccagtttgcaaagtgggtcccatcaaggttcatcggcagtggatcgtgggacagatttcactctcaccatcagcagcctgcagcctagagtattttgactaacttactattgtacaacgaggactaactacggtttcccgaagggtaccgttacggaccgtaaacggggaccctaaaggggtacggaaaactaccgaaaacgaacgttaggtacggaaccgtacggacctaaccgacttccgtacgtttcctttaccg

SEQ ID NO: 339339 - DNA, 578 bp, Homo sapiens
  misc_feature: GZ8MTXP02II529.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctgtagctggtatcagcagaaaccaggaaagcccctaagctcctgatctatgctgcatccagtttgcaaagtggggtcccatcaagtcatcgcagtgatcgtggacagattcactctcaccatcagcagcctgcagcctgaagattttgactaaactttacttattcgttacaaacgtacggtacttaaacgtacggttttaccccggaagggtaccgtttaccggggaccctaaaacgggggaacccgaaaagggtacgggtaaaaacttaaaccgaaaacggtaaaaccttggtaacgggcttacggaccaccctaagttccttcggttactttacccg

SEQ ID NO: 339340 - DNA, 609 bp, Homo sapiens
  misc_feature: GZ8MTXP02HWZLJ.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagatcaccatcacttgcgggcagtcagggtatagcagctggtagcctggtatcagcaagaaaccagggaaacgcccctaagctcctgatctatgctgcatccagtttagacgaaaggtcggggtacccccagtacgaaggttcaggacggcaggttggaatcgtaggggactagtactttcacttccacaccataccacccagccctggccgaccgtagtaaagtattttgactaaactttattactgtacaaacgaggacctaaacgtacggtttacccgaagggtaccggtttaccggaccgaaaacgggggaaccctaaaaggggttaacggaaaactaaacgaaaaccggtaacgtagggttaacggcccgtaggaccctaacaacgttcttcggtttaccc

SEQ ID NO: 339341 - DNA, 589 bp, Homo sapiens
  misc_feature: GZ8MTXP02HT4L5.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcctccctgtctgcatctgtaggagacagagtcaccatcacttgccggcaagtcagggacaattaaaatgtatttagctggtatcagcaagaaaccaagggaaactccgtaaggtcctagatctatgatcgcctaccgtagtttagggaaagttcggggtacccagtcgaaggttcaggcggcctaggtgatcgtagggactagtctttcactctaccaccactacaccacgcctcggcgtcctagtaagttattttacgacttaacttattactacgtaacttaaacttaaattttactttagttactccgtacttacgtacgtttcgggacgggtacggtaaccgaagggtagacgaactaacgaaaacgacgtgttacgctacgcctactaatctcgttctatacttccttccgac

SEQ ID NO: 339342 - DNA, 510 bp, Homo sapiens
  misc_feature: GZ8MTXP02HPFSK.39.28.C06.1.454.CMB.2.raw
  modified_base (341)..(341): a, c, t, g, unknown or other
  misc_feature (341)..(341): n is a, c, g, or t
tcagtcgcactagtcacgaccggtgctcgatttagagctcacgtattgggtttggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggtagcctggtatcagcagaaaccagggaaagcccctaagctcctgatctatgctgcatccagtttgcaaagtgggtccccatcaaggttcatcgcngtggatctgggacagatttcactctcaccatcagcagcctgccagcctgaagtattttgctaacttactatttgacaaacaggactaacagtttacccgaaggtacgttacggaccaaagggacccaaaggtacggaaaatacaaaacgaactgtaggctagcaccatc

SEQ ID NO: 339343 - DNA, 652 bp, Homo sapiens
  misc_feature: GZ8MTXP02ILNVX.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtattagcagctggttagcctggtatcagcagaaaccagggaaacgcccctaagctcctgatctatgctgcatcctagtttgacgaaaggttcggggtacccctagtacgtaaacggtttccaagttcgggctaaggtggtaattccgtggggaactagtattttccaactccttaccaaccctaatccgaagccgaacgcccttgaccgacgtccctaggtaaagtacttttagaccttaaactttacttattacgttacaaacgacggtacttaaacgtacgtttacccggaaggttaccggttaccggaacccgaaaacggggaacccaaaggggttaacgaaaaacgttaacgaaaaccggtaaaccttagggtacggaacgttacgaccgtaaccctaagtcctttacggtcctttaaccg

SEQ ID NO: 339344 - DNA, 548 bp, Homo sapiens
  misc_feature: GZ8MTXP02H26VD.39.28.C06.1.454.CMB.2.raw
  modified_base (201)..(201): a, c, t, g, unknown or other
  misc_feature (201)..(201): n is a, c, g, or t
  modified_base (273)..(273): a, c, t, g, unknown or other
  misc_feature (273)..(273): n is a, c, g, or t
  modified_base (345)..(345): a, c, t, g, unknown or other
  misc_feature (345)..(345): n is a, c, g, or t
  modified_base (412)..(412): a, c, t, g, unknown or other
  misc_feature (412)..(412): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcacatcacttgcgggcagtcaggtatagcagctggtagctggtatcagcagaaaccagggaaacncccctaagcctcctgatctatgctgcatccagtttgacaaaggtggggtacccccagtcaaggtcatcggcnggtgatcgtagggacagtatttcactctacacatacagacacgctgacagctagtaacgtattttanactaacttactattacgtacaacgtacggactaaacgtacgttacccgaggtaccgttacggaccgtaaagggaacccgaaaggttacggaaaactacgaaaacgtaacgtcggtaaggctagactaccaattccg

SEQ ID NO: 339345 - DNA, 559 bp, Homo sapiens
  misc_feature: GZ8MTXP02H36CE.39.28.C06.1.454.CMB.2.raw
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtattagcagctggttagcctggtatcagcagaaaccagggaaancccctaagctcctgatctatgctgcatccagtttgacaaagtggggtcccccagtcaaggttcatcggcngtgatcgtgggactagtatttcactctcaccatcagcagctgcagctagaatattttgactaactttactattacgactaacaggacttaaactacggtttcccgaaggtaccggtttaccggaccgaaacggggtaacccgaaagggtacggaaaaacttaccgaaaaacggtaaccgttggtacgggactacggaccacctaacgttccg

SEQ ID NO: 339346 - DNA, 635 bp, Homo sapiens
  misc_feature: GZ8MTXP02JT1MX.39.28.C06.1.454.CMB.2.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
tcagtcgcactagtcacgaccggtgctcgatttagagctcacgtattgggtttggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgcggcagtcaggtntagcagctggtanctggtatcagcagaaccnggaactcccctaagctctgactctatgctgcatcgagtttcgactaaaggtcggtacccctagtacgaaggttcagtccggatggtacgattcgtaggactagttactttacgacgttctaccgaccgtatccgtaagtcctacggtacctcggacctacggtccttaggtaaacgttacgtttacgaccttaaacgtttaccgtagttacggtacctaacgttacgtaaccgttaacgtacggtttacccgaaggttacccggttacggaaccgtaaacgggtaccgtaaacgggttaccgtaaaacgtaccgtaaaacggtaaccgttacggttacggtacgttacgtaccgtaaccgtagtttacccgg

SEQ ID NO: 339347 - DNA, 580 bp, Homo sapiens
  misc_feature: GZ8MTXP02JMLBR.39.28.C06.1.454.CMB.2.raw
  modified_base (374)..(374): a, c, t, g, unknown or other
  misc_feature (374)..(374): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcaagaaaccagggaaagcccctaagctcctgatctatgctgcatccagtttgcaaaggtcggggtcccatcaacggttcatcggcagtggatcgtgggacagtatttcactctcaccntcagcagcctgcagcctgaagtattttagactaaacttacttattgtacaacaggactaactacgtttccgaagggtaccgttacgggaccgaaaacggggacccgtaaagggttaacgggaaaacgttaccgaaaacggtaaaacgttcgggttaacggccgttacggacctacccgtaaagttcccttaggtttacctttaccg

SEQ ID NO: 339348 - DNA, 744 bp, Homo sapiens
  misc_feature: GZ8MTXP02JBARB.39.28.C06.1.454.CMB.2.raw
  modified_base (201)..(201): a, c, t, g, unknown or other
  misc_feature (201)..(201): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcagctggttagcctggtatcagcagaaaccagggaaacacccctaagctcctgatctatgctgcatcctagtttgacgtaaaaggtcggggtaccccccagtaccgtaaacggtttccacgttaccggggactagggttagggtaacgttaccggttacgggggaacctaagggtaactttttaccaaacccttccttacccaaaccctaacttacccgaaacgacccgtaaccggccccgttacggacccgaacgtaccccgttaaaggtaaacggtttaaacttttttacccggaaccttaaaaccttttaaccggttaatttacggtaacctaaaacggtacggtaaaccttaaccgttaaccggttttaccccggtaacgggttaaccggtttacccgggaacccggtaaaacggggtaaacccgtaaagggtaaacggtaaaacgttaccgaaaaaccggtaacgtacggtacggtccgtagaccctacgaactttccg

SEQ ID NO: 339349 - DNA, 531 bp, Homo sapiens
  misc_feature: GZ8MTXP02JDYKG.39.28.C06.1.454.CMB.2.raw
tcagtcgcactagtcacgaccggtgctcgatttagagctcacgtattgggtttgggggcaggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcattaaaatgattagcctggtatcagcagaaaccaggaaactctaaggtcctgatctatgatgcctcagtttggaaagtggggtccatccaaggttcagcggcagtgagtcgtggggacagtatttcactctacacatcacagcctgccgctgaagtatttgactaatttattactgtacaactaatttattcttactccgtctactacgtttcgggacggtaacgggaccgtaaagggtggaacgacttaacgaaaacgtacgtagtggactcggacctacctattcgtagtttcc

SEQ ID NO: 339350 - DNA, 590 bp, Homo sapiens
  misc_feature: GZ8MTXP02HKZXC.39.28.C06.1.454.CMB.2.raw
  modified_base (201)..(201): a, c, t, g, unknown or other
  misc_feature (201)..(201): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagatcaccatcacttgtcgggcagtcagggttatagcagctggttagcctggtatcagcaagaaaccgagggaaacgcccctaagctcctgatctatgctgcatcctagtttgacgtaaaggtcggggtacccccagtacgtaaggttcagtcggacaggtggatccgtggggactagtatttccacttctacaccagtcagtcacgcctgccacgtcctaggtaacttattttgaccttaacttattagtttacgaccaagtacggaccttaaacgtacgttacccgaggtaccgttacgggaccgaaaacgggtaccgaaagggtacggtaaaactaacgtaaaaccgaacgttggtacggtactcggacctactaacgtttccg

SEQ ID NO: 339351 - DNA, 589 bp, Homo sapiens
  misc_feature: GZ8MTXP02JI7DH.39.28.C06.1.454.CMB.2.raw
  modified_base (202)..(202): a, c, t, g, unknown or other
  misc_feature (202)..(202): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctggtagganacagagtcaccatcacgttggtcgggcagtcagggtattagcagctggtancctggtatcagcaagaaaccgagggaacncccctaagctcctgatctatgctgcagttcctagtttagactaaaggtcggggtacccccagtaccgtaaggttcagtcggactaggtggatcgtaggggaactaggtatttccacttctaccaccatcagtcacgccctgaccacgtccttagaagttattttacgaccttaaactttacgttattacgtaacgaacgtacgtacttaacgtacggtttaccgaggttaccgtacggaccgtaaacgggaccgtaaggtacgaaaactacgaaaacgtaagtgtacgacgtacgacctaccattcg

SEQ ID NO: 339352 - DNA, 646 bp, Homo sapiens
  misc_feature: GZ8MTXP02G92BN.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggtattagcagctggttagcctggtatcagcaagaaaccgagggaaacgcccctaagctcctgatctatgctgccattccagtttgacgaaaaggttcggggtacccccccagtaccgtaaggtttcaggtcgggcaggtgggtatcgtaggggacaggtaatttccgacttctaccacctatccacccgagccctgcccggccttagaagtaactttttcgaccttaaacctttattaaccgttacgttacaaaccgtagggacttaaaccgtacggttttaccccggaagggtaccgttaccgggtaccgaaaacggggaccgtaaaacgggttaggaaaacgttaccgaaaaacggaaccgttaggtaacggaccttacggacctaacctacgtttactacggtttccc

SEQ ID NO: 339353 - DNA, 544 bp, Homo sapiens
  misc_feature: GZ8MTXP02HVMU5.39.28.C06.1.454.CMB.2.raw
  modified_base (346)..(347): a, c, t, g, unknown or other
  misc_feature (346)..(347): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggttagcctggtatcagcagaaaccagggaaacgcccctaagctcctgatctatgctgcatccagtttgacaaaggtcgggtccccatcaaggttcatcggnngtgatcgtgggacagatttcactctcacatcagcagcctgcagcctagagtattttgactaacttactattcgtacaacaggtactaaacgtacgtttacccgaggtaccggttacggaccgaaacgggaccgaaaggtacgggaaaacttacgaaaacgtaacgtaggtcggtactacggaccaaccgtacttccg

SEQ ID NO: 339354 - DNA, 570 bp, Homo sapiens
  misc_feature: GZ8MTXP02JQH92.39.28.C06.1.454.CMB.2.raw
  modified_base (201)..(201): a, c, t, g, unknown or other
  misc_feature (201)..(201): n is a, c, g, or t
  modified_base (414)..(414): a, c, t, g, unknown or other
  misc_feature (414)..(414): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctactgctctggttcccaggttccagatgcgacatccagatgacccagtctccatcttccgtgtctgcatctgtagganacagagtcaccatcacttggtcgggcagtcagggtattagcagctggttagcctggtatcagcagaaacccagggaaacgcccctaaagctcctgatctatgctgcatccagtttgactaaaggtggggtaccccagtcgaaaggtttcagtcggcagtggatcgtgggacagtatttcactctcaccatcagcacgcctgcagcctagaatntttcgactaattactattgtacaacgtaggtacctaactacgtttacccggaggtacccggttacggaccgaaacggggacccgtaaagggtacggaaaactaccgaaaacggtaaacgtggtacggacgtacggacctaaccctagtcctttacg

SEQ ID NO: 339355 - DNA, 574 bp, Homo sapiens
  misc_feature: GZ8MTXP02JUN1Z.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctatgctgcatccagtttgcaaagtggggtcccccatcaaggttcatcggcagtggatcgtgggacagtatttcactctcaccatcagcacgcctgcagcctagaagtatttcgactaactttactattgttacaaactacgggtacctaaacgtacgtttacccgaagggttaccgtttaccgggaccgaaacgggggacccgtaaaagggttacgggaaaacttaccgaaaaacggtaaccgttaggtacgggacctaggacctaacccgtatttccg

SEQ ID NO: 339356 - DNA, 629 bp, Homo sapiens
  misc_feature: GZ8MTXP02JSG9C.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcgagtcagggtattagcagctggtagctggtatcagcagaaaccgaggaaacgcccctaagctcctgatctatgctgcatccagtttgacgtaaaggtcggggtacccagtcaacggttcagtcggcaggtcggatcgtgggactagtatttcactctaccaccatcagcacgccctagccgacgacctagtaaagttactttttacggaaccttaaactttacttaacgttacgtaccgaaacgtacgggtaaccttaaaccggttacggtttaccccgggaacgggttaccggtttaccgggacccggtaaaacggggacccggtaaaggggttacggaaaacgttaaccggaaaacgtaccgtaggtacggaacgtacggtaccaccgtactaccgttcgtactttcc

SEQ ID NO: 339357 - DNA, 595 bp, Homo sapiens
  misc_feature: GZ8MTXP02FYNJM.39.28.C06.1.454.CMB.2.raw
  modified_base (401)..(401): a, c, t, g, unknown or other
  misc_feature (401)..(401): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagcctcctgatctatgctgcatccagtttgacaaaggtcgggtccatcaaggttcagtcggcaggtgatcgtgggacagtatttcactctcacctatcagcagccctgccagcctgaaagtntttagactaaacttactattgtacaaacgtacggactaaacgtacgtttacccggaaggtaccggttaccgggaccgtaaaacggggtacccgtaaaaggggtacgtaaaaacgttaccgaaaaaccggtaactacgggttacgggaaccttacggaccgaacccctaagttcgttaccggttcctttaacccg

SEQ ID NO: 339358 - DNA, 739 bp, Homo sapiens
  misc_feature: GZ8MTXP02F5QYP.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgagggtattagcagctggttagcctggtatcagcaagaaaccgagggaaacgcccctaagcctcctgatctatgctgcatcctagtttagacgtaaaggtcggggtacccccctagtaccgtaagggtttcaagttccggacgtaggttgggaacgttcgtagggggaacctaaggtaacttttcccaaccttccttaccaaaccctaattacccgaacggacccaacggtcccccttaggacccaacggtccccgttaaagggtaaacggttaattttttacggaacccttaaaaccgtttttaacctaagtttacggtacctaaacgtaacgggtaccttaaaccgtaccggttttacccccgggtaaggtaacccggtttaccggggaaacccgtaaaacgggggtaaacccgtaaagggggttaaacgggaaaaacttacccggtaaaaaccggtaacgttaacgggtcggtaccgtaacggaccctaaccgtaactttccgg

SEQ ID NO: 339359 - DNA, 618 bp, Homo sapiens
  misc_feature: GZ8MTXP02I51A3.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagacagaaaccgagggaaacgcccctaagcctcctgatctatgctgcatcctagtttgacgtaaaggtcggggtaccccagtacgtaacggttcagtcggactaggtggtatcgtgggactagtactttcactctacaccatcagcagcctgccagcctagaagtattttagaccttaaacttacttattacgtactaaacgtacggtacttaaacgtcggtttacccggaacgggttaccggttaccgggaaccggtaaacggggaacccggtaaaggggtaacggaaaactaccgtaaaaccggtaacgtaggtacggtccgtacggacctaaccgtacttcgtttacgttacctttaccg

SEQ ID NO: 339360 - DNA, 565 bp, Homo sapiens
  misc_feature: GZ8MTXP02JSIIZ.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgagggtattagcagcgtggttagccgtggtatcagcaagaaaccgagggaaacgcccctaagcctcctagatctatgctgcatcctagttgacgtaaaggtcggggtacccccagtacgtaacggttcagtcggcaggtgagtcgagggactagtacttcactcctacaccatcagtcacgccgtgaccagtccgtagtaagttatttacgacttaacttacttagttcgtacaacgtaggtactaaccgtcgttaccgaggtacgtacggacgaacgggacaaggtacgaaactacgaaacgtaagtagtacggctacgacctaccgtatcg

SEQ ID NO: 339361 - DNA, 619 bp, Homo sapiens
  misc_feature: GZ8MTXP02J3U30.39.28.C06.1.454.CMB.2.raw
  modified_base (414)..(414): a, c, t, g, unknown or other
  misc_feature (414)..(414): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagagacagagtcaccatcacgttggcgggcgagtcgagggtattaggcagtcttggttacgccgtggtatcaagacaaacggaaaccgaagggaaacctcccctaagcctacctgacttctatcgctgaccagttcctagtttacgacgtaaacggtcgggtaccccagtacgtaacggtcagtcggactagtggatcggagggtaactagtactttcacttcnccaacactcacgcacgcctggctacgctaaggtatctttacacttaacttatattacacgaacgtacgtaccttaacggtacggtttaccgggacggttaccggttaaccggaacggtaacgggaacccgtaaagggtacgaaaactacgaaacgtacggttacggacgccttacgacctaacttactccgtttactccttaccg

SEQ ID NO: 339362 - DNA, 500 bp, Homo sapiens
  misc_feature: GZ8MTXP02HSMJV.39.28.C06.1.454.CMB.2.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtatagcagctggttagctggtatcaacagcacccggggaaggttcctagactcctgatctatgatgcatccaatttagaaccaggggtcccatctcgattccagtggnggtgggtntgggacngatttcactctcacatcagcagcctgctgcctgaagtatgctgactaaattattactgtacaaaagtatagacagtcgtccgtggacgtcggacccagggaccaaaggtcgaaaatacaaacgactgtgaactgcaccatctcgtcttac

SEQ ID NO: 339363 - DNA, 521 bp, Homo sapiens
  misc_feature: GZ8MTXP02HINXX.39.28.C06.1.454.CMB.2.raw
  modified_base (201)..(201): a, c, t, g, unknown or other
  misc_feature (201)..(201): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcagctggttagcctggtatcagcagaaaccagggaaactcctaaggtcctgatctatgatgcctccagtttggaaagtggggtccatcaaggttcagcggcagtggatcgtgggacagtatttcactctcaccatccaccagcctgcgcctgaagtatttgactaacttattactgttacaactatttaattcttaatccgtctctacgtttcggacgtacgggaccaagggtggaagtatacgaaaacgactgtacggctggacacctatctagtcttac

SEQ ID NO: 339364 - DNA, 552 bp, Homo sapiens
  misc_feature: GZ8MTXP02FKZJC.39.28.C06.1.454.CMB.2.raw
  modified_base (274)..(274): a, c, t, g, unknown or other
  misc_feature (274)..(274): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaacncccctaagctcctgatctatgctgcatcctagtttgacgtaaaaggtcggggtacccaagtacgaaacgggtttcaagtcggcaggtggatcgtgggacagtatttcactctacacatcagcagcctgcagcctagaagtattttagactaaactttactattacgtactaaacacggtactaaacgtacgtttacccggaggtacgttccggaccgtaaagggaccgaaaggtacgaaaatacaaaacgtactgtacgcgtgacacatctcgtctac

SEQ ID NO: 339365 - DNA, 602 bp, Homo sapiens
  misc_feature: GZ8MTXP02GT8WV.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtattagcagctggttagcctggtatcagcagaaaccagggaaagcccctaaagctcctgatctatgctgcatccagtttgcaaagtggggtcccatcaaggtcatcggcagtgatcgtgggacagatttcactctcaccatcagcagccctgccagcctagaacgtattttagactaaactttacttattagttacaaacacggacttaaaccgtaggttttaccccgaagggtaccggtttcggaccgtaaacgggggaaccctaaagggtacgggtaaaacttaccgaaaaacggtaaaccgttagggttacgggaaccgtttacgggacccgtaaaccccgtaatttaccgttcggttaaccgttttacccg

SEQ ID NO: 339366 - DNA, 583 bp, Homo sapiens
  misc_feature: GZ8MTXP02GKDRI.39.28.C06.1.454.CMB.2.raw
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcgagggtaattaaaatgatttagcctggtatcagcagaaaccagggaaaactctaaggtcctgatctatgatgcctccagtttggaaagtggggtcccatcaaggtcacgcggcagtggatcgtggggcagtatttcactctacaccatcacagcctgcgcctagacgtntttgactaacttatacgtntacaacttaatttaattcttatcccgtctacttacgtttcggacgggtaacgggtaccgaaaggggttcggaagtaacgttaaccgaaaaacggtaaccgtagggttaacgggcttcggaaccgtaaacccaggttcccgtagttccttactaactttcccccg

SEQ ID NO: 339367 - DNA, 540 bp, Homo sapiens
  misc_feature: GZ8MTXP02F0OW7.39.28.C06.1.454.CMB.2.raw
  modified_base (281)..(281): a, c, t, g, unknown or other
  misc_feature (281)..(281): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcaagaaaccagggaaacncccctaagctcctgatctatgctgcatcctagtttgacaaaggtcggggtaccccagtcaaggttcatcggacaggtgatcgtagggactagtatttcactctcacatcagcacgctgcagcctagaatatttacgactaactttacttattacgacaacgaggtactaacgtagtttcccgaggtacgttcggacgtaaacggaccaaaggtacgaaaactacgaaaacgaacgtgtacggactacgacaccgtatcg

SEQ ID NO: 339368 - DNA, 591 bp, Homo sapiens
  misc_feature: GZ8MTXP02FRL44.39.28.C06.1.454.CMB.2.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (430)..(430): a, c, t, g, unknown or other
  misc_feature (430)..(430): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgagggtattagcagtctggttanccgtggtatcagcaagaaaccgagggaacncccctaagcctcctgatctatgctgccatcctagtttcgacgtaaaggttcggggtacccccataccgtaaagggttcagtccggctagggtggagttcgtaggggactaaggtactttacactctaccaccatcagcacgcctncacgcctagaattatttacgacttaacttacgtattcgtacgaaacgtaggtaacctaacgtacgtttccggaacggtacggttacggaccgtaaacggaccgtaaagggtacgaaaactacgaaaacgtaacgtggtacggactagaccgtactacttcg

SEQ ID NO: 339369 - DNA, 564 bp, Homo sapiens
  misc_feature: GZ8MTXP02FW7DE.39.28.C06.1.454.CMB.2.raw
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcagctggtagcctggtatcagcagaaaccagggaaancccctaagctcctgatctatgctgcatccagtttgacaaagtgggtccatcaaggttcatcggcagtggatcgtgggacagatttcactctcaccatcagcagccctgcagcctagaacgtattttcgactaaacttactacttgtaacaacaggtactaaacgtacggtttacccgaggtaccgttcgggacctaaaacggggaccaaaagggtacgaaaaacgttacgaaaacccgtaaacgtggttacggaacgtacggaacaaccctaagttcctaggtctttaacccg

SEQ ID NO: 339370 - DNA, 565 bp, Homo sapiens
  misc_feature: GZ8MTXP02FZDX6.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcattgtcgggcagtcagggtattagcagctggttagcctggtatcagcagaaaccagggaaacgcccctaagctcctgatctatgctgcatccagtttgcaaagtggggtcccccatcaaggtcatcggcagtgatctgggacagattcactctacacatcagcagcctgcacgcctagaacgtatttacgactaaactttactattacgtacaacgtacggaacttaacgtacgtttacccgaggtaccggtttcggacccgaaacggggaaaccgtaaagggtaacggtaaaacgtaccgaaaaacggtaaccgttagtacgggtcctaggaccgaacctaactttccg

SEQ ID NO: 339371 - DNA, 666 bp, Homo sapiens
  misc_feature: GZ8MTXP02GFDYL.39.28.C06.1.454.CMB.2.raw
  modified_base (273)..(273): a, c, t, g, unknown or other
  misc_feature (273)..(273): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggtagcctggtatcagcaagaaacgaggaaacncccctaagctctgatctatgctgctactcctagtttagacgtaaaggtcggggtacccaagtacgtaacggttcaagtcggactaggtggattcgtagggaacagttactttcactctacaccatacagtcacgtcctggaccacgtacctagtaaattacgttttagaaccttaaactttaaccttattacgtaaccaaacgtacggtaaccgttaaacgttaacggtttaccccgggaagggttaacccgggtttaccggaaaaccggtaaaacggggtaaacccggtaaaaggggttaaacgtaaaaacgtaaaccgaaaaccggttaaacgtcggttacggaacgttacgaacctaccgtaacgttccgttacggtttaactttacccg

SEQ ID NO: 339372 - DNA, 544 bp, Homo sapiens
  misc_feature: GZ8MTXP02G253J.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggttagcctggtatcagcaagaaaccgagggaaacgcccctaagcctcctgatctatgctgcatccagtttgacaaaggtgggtcccatcaaggttcatcggcagtgatcgtgggacagtattcactctcaccatcagcagctgcacgctagaagtatttgactaaattacttattgtacaaacacggacttaacgtacggtttaccccgagggtaccgttcggaaccgtaaacgggaaccgaaagggtacggaaaacttacgaaaacgtaacgtcgtaggctacgacacctatctcgttacttac

SEQ ID NO: 339373 - DNA, 565 bp, Homo sapiens
  misc_feature: GZ8MTXP02IICLX.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctaatgctgcatccagtttgcaaagtggggtcccatcaagttcatcggcagtggatcgtgggacagatttcactctcacatcagcagcctgcagcctgaaagattttagactaaactttacttattcgtacaaacaggacttaaacgagttttccccgaaggtaccgtttacgggaccaaagggggacccaaagggtacggaaaagtaccgtaaaacggaaaacgttagtacgggaacgttcggactaacccgaattccgttacggttctttaaccg

SEQ ID NO: 339374 - DNA, 551 bp, Homo sapiens
  misc_feature: GZ8MTXP02GHBXC.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcagtcagggtattagcagctggtagcctggtatcagcagaaaccagggaaacgcccctaagctcctgatctatgctgcatccagtttgacaaaggtggggtacccccatcaaggttcatcggcagtgatcgtgggacagtatttcactctacacatcagcagcctgcacgtcctagaacgtattttgactaactttacgtattgtacaacgaggtacctaacgtacgtttacccggaaggtaccggttcggaccgtaaacggggaccaaagggttacgaaaactacgaaaacggaacgtggtacggctacggacaaccttactcg

SEQ ID NO: 339375 - DNA, 661 bp, Homo sapiens
  misc_feature: GZ8MTXP02IOM90.39.28.C06.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttggcgggcagtcgagggttattaggcaggtcttggttagcctggtatcagacaagaaaccgagggaaacnccctaaagcctacctgatctatgctgactactcctagtttgacgtaaaggtcggggtaccctaagtacgaacgttcaagtcggactaggtgatcgtagggactagtacttcactctacacatcagcagctgacagcctagtatagttttacgacttaaactttacgttattcgtaacctaaacgtaacgggtacttaaaccgttaccggtttacccggaacgggttaaccgttaccggggaaacccgtaaaacgggggtaaacccgtaaaaggggttaaccggaaaaacgtaacccggtaaaaacggtaaccggtaggttaacggaaccgttacggaaccgttaaccctaacgttccgtttacgtttacctttaacccg

SEQ ID NO: 339376 - DNA, 543 bp, Homo sapiens
  misc_feature: GZ8MTXP02JZBQO.39.28.C06.1.454.CMB.2.raw
  modified_base (349)..(349): a, c, t, g, unknown or other
  misc_feature (349)..(349): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctatgctgcatccagtttgacaaaggtggggtcccccatcaaggttcagtcggcngtggatcgtgggacagtatttcactctacaccatcagcagcctgcagcctagaagtatttgactaacttactattgtacaacaggtactaacgtacgtttcccgaggtaccgttacggaccgtaaacggggaccaaagggtacggaaaacttacgaaaacgtaacgtggtacggactaggacctaccatttccg

SEQ ID NO: 339377 - DNA, 606 bp, Homo sapiens
  misc_feature: GZ8MTXP02FH4WM.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggtagcctggtatcagcagaaaccagggaaagcccctaaagctcctgatctatgctgcatccagtttgcaaaggtggggtacccatcaaggttcagtcggcagtggatctgggacagatttcactctcaccatcagcagcctgcagcctagaagtattttacgctaaactttactatttgtaccaaacgacggtaccttaaacgacggttttaccccggagggtaccggtttaccgggaacccgtaaaacgggggaaccccaaaagggggttacggaaaaacttaccgaaaaaccggtaaactcgggttacggggaaccttcgggaccctaaacccgtaacgtttaccgttacgttccctttaacccg

SEQ ID NO: 339378 - DNA, 570 bp, Homo sapiens
  misc_feature: GZ8MTXP02I1MS3.39.28.C06.1.454.CMB.2.raw
tcagtcgcactagtcacgaccggtgctcgatttagagctcacgtattgggtttgggggcaggagtcagacccagtcaggacacagcgtggacatgagggtcccccgctcagctcctggggctcctgctgctctggttcccaggttccagatgcgacatccagatgacccagtctccatcttccgtgtctgcatctgtaggagacagagtcaccatcacttggtcgggcgagtcagggttattagcagcgtggttagcctggtatcagacaagaaaccgaagggaaacgacccctaagcctctgatctatgctgacatcctagttcgacgtaaaggtcgggtacccccataccgtaagttcacgtcggcaggtgatcgtagggactagtactttcactctccaactatcagcacgcctgcacgtctaggtaagttatttcgattaaacgttactattagaccaacgagtactaacgtcgttaccggaggtaccgtacggaccgaaacgggaacgaaacggtacgaaaacgtaccgaaaacgtaacgtgacggctacgacctaactgttacc

SEQ ID NO: 339379 - DNA, 680 bp, Homo sapiens
  misc_feature: GZ8MTXP02GX68A.39.28.C06.1.454.CMB.2.raw
  modified_base (275)..(275): a, c, t, g, unknown or other
  misc_feature (275)..(275): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcgagggtattagcagctggttagcctggtatcagcagaaaccgagggaaacnccccaagctctgatctatgctgcactccagtttcgactaaaggtcggggtaccagtacgaacgttcacgtcggactaggtggatcggtgggactagtactttccacctctaccaacctataccgagtaccgacgtcccgtacgccgaacgtccgtaagtaaagttacgttttacgaccttaaaacctttacgtttaagtttcgtaaccgtaaaccgtacggtaaaccttaaacggttacggtttaacccccggaagggttaaccccggtttaccgggaacccggtaaaacggggtaaacccgtaaagggttaaacgggaaaacgttaaccgtaaaaccggtaaccgttaggtacggtaaccgttaacggaccctaccgtacgttccttacggtttctttaacccg

SEQ ID NO: 339380 - DNA, 612 bp, Homo sapiens
  misc_feature: GZ8MTXP02G229A.39.28.C06.1.454.CMB.2.raw
  modified_base (220)..(220): a, c, t, g, unknown or other
  misc_feature (220)..(220): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggngagtcagggtatagcagcgtggttagcctggtatcagcagaaaccagggaacgcccctaagctcctgatctatgctgcatccagtttcgactaaagggtcggggtaccctagtcgtaacggttcagtcggacaggtggatcgtggggactaggtactttcgactctacaccatcagcctagccctagccgacgtcctagtaagtacttttagaccttaaacgtttacttattacggtacaaacgtacggtaccttaaacgtacgtttacccggaagggttaccggttaccgggaaccgtaaacggggtaaccgaaagggttacggaaaactaccgaaaacgtaccgtaggtacggaacgtcggaacctacgtactcggttacgtcgtttacc

SEQ ID NO: 339381 - DNA, 587 bp, Homo sapiens
  misc_feature: GZ8MTXP02IAXM3.39.28.C06.1.454.CMB.2.raw
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagatcaccatcacttggtcgggcgagtcgagggttattagcagcgtggttagcctggtatcagcaagaaaccgagggaaacgcccctaagctcctgatctatgctgcatcctagtttgacaaaggtcggggtcccaagtctaacggttcagtcggacaggtggatcggtgggaacagtactttcactctacaacctancagcncgcctcgcacgtacgtagtagttatttacgtaaccttaacttacttagttacgtaacaaacgtacgtacgtaacgttcggttaccggaggtacgtaccgggaaccgaaacgggaacggtaaagggtaacgaaaactaacgaaaacgtacgttggtacggtcgtacgactactacgtcttactctac

SEQ ID NO: 339382 - DNA, 685 bp, Homo sapiens
  misc_feature: GZ8MTXP02FNHI1.39.28.C06.1.454.CMB.2.raw
  modified_base (283)..(283): a, c, t, g, unknown or other
  misc_feature (283)..(283): n is a, c, g, or t
  modified_base (434)..(434): a, c, t, g, unknown or other
  misc_feature (434)..(434): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagagtcaccatctacgttggtcgggcgagtcgagggtattagcagcgttggtacgcctggtatcagacaagaaaccgaggaaacncccctaagcctcgtgatctatcgctgactagtacctaggtttacgacgtaaaaggggttcggggtaccctagtacgtaaacggttcacgtcggacgtaggtcggatcggtagggaactaggttacttccaactcctacaaccatcagcgancccgtgacctaggtaccttaggtaaacttacgttttacgaaacctaaaccgtttataacgtttacgtaaccgtaaaacgtcggtaaccttaaaccggtcggttttaccccgggaagggttacccgttaacggggaaccgtaaaacggggaaaccgttaaaggggaaaccggtaaaactaaccggtaaaaacgtacgtggtaaccggcttacggaccctaaccgttacgtttacgttaccgtaccttaaccg

SEQ ID NO: 339383 - DNA, 528 bp, Homo sapiens
  misc_feature: GZ8MTXP02J3D0W.39.28.C06.1.454.CMB.2.raw
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
  modified_base (509)..(509): a, c, t, g, unknown or other
  misc_feature (509)..(509): n is a, c, g, or t
  modified_base (521)..(521): a, c, t, g, unknown or other
  misc_feature (521)..(521): n is a, c, g, or t
tcagtcgcactagtcacgaccggtgctcgatttagagctcacgtattgggtttgggggtcagaccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagctggtatcagcagaaaccagggaagcccctaagctcctgatctatgctgcatccagtttgcaaagtggggtcccatcaacggttcatcggcagttggatcgtagggactagtatttcactctacaccatcagcagccctgcngcctgaagtattttgactaaactttntatttgacaacaggtctaactgtttaccccggaggtaccggtttcggaccgaagggaccaaagggtacgaaaataccgaaaaccgacgtgtggcgtnacacctatcttntcctttc

SEQ ID NO: 339384 - DNA, 635 bp, Homo sapiens
  misc_feature: GZ8MTXP02IKSSN.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaacgcccctaagctcctgatctatgctgcatcctagtttgactaaaggtcggggtcccagtcgaaacggttcagtcggctaggtggatcgtagggactagtatttccactctacacctatcagcagcctagcacgtcctagtaagtatttacgacttaaacttacttattcgtacaaacgtagtaaccttaaacgtacggtttcccggaaggtacccgttacgggaacccgtaaacgggggtaaaccctaaaagggggtaacgtaaaaacgttaaccggaaaaaccggtaaacgttacgggtaacggtaaccgttacggaaccctaaaccccggtaatttcccgttacggtttaccctttaacccg

SEQ ID NO: 339385 - DNA, 581 bp, Homo sapiens
  misc_feature: GZ8MTXP02IGFC7.39.28.C06.1.454.CMB.2.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (366)..(366): a, c, t, g, unknown or other
  misc_feature (366)..(366): n is a, c, g, or t
  modified_base (407)..(407): a, c, t, g, unknown or other
  misc_feature (407)..(407): n is a, c, g, or t
  modified_base (464)..(464): a, c, t, g, unknown or other
  misc_feature (464)..(464): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcattctgtagganacagatcaaccatcacttggcgggcgagtcgagggtattagcagctggttagcctggtatcagcaagaaaccgagggaaacncccctaagcctcctgatctatgactgctatcctagtttgacgtaaaggtcgggtacccctagtacgtaagttcagtcggacngggtgatcgtagggactagtactttaccacttctaccgacntacacgcacggctgaccagcctaagtacgttatttcaacttaacttacttattcganaacgtaggtaactacgtacgttccggaagtaccggttacgacgaaacggtaaaccaggtaacgaaaactacaaaacggtaacgttagacggtacctagtacccaacgttacgttccg

SEQ ID NO: 339386 - DNA, 606 bp, Homo sapiens
  misc_feature: GZ8MTXP02IQK7N.39.28.C06.1.454.CMB.2.raw
  modified_base (201)..(201): a, c, t, g, unknown or other
  misc_feature (201)..(201): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcagctggttagcctggtatcagacaagaaaccgaggaaacgcccctaagcctacctgatctatgctgctatcctagtttgacgtaaaggtcgggtaccccagtacgaaggttcacgtcggacgaggtggatcgtaggactagtacttcactctacactatacagcacgcctgacacgtcctagtaagttatttcgactaactttactattcgtaactaacgacggtactaaaccgtacggtttaccccgaaggttaccggttaccgggaccgtaaacgggtaaaccgtaaaggggtaacgaaaacgttaaccgaaaaccggtaacgttacggtacgggtacctacggaccctaaccgttacttccg

SEQ ID NO: 339387 - DNA, 666 bp, Homo sapiens
  misc_feature: GZ8MTXP02GVPO1.39.28.C06.1.454.CMB.2.raw
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcagggttatagcagctggtagctggtatcagcaagaaaccgaggaacncccctaagcctctgatctatgctgctattccgtagtttcgacgtaaaggtcggggtaccccagtacgtaagtcagtcggctggtgagtcgagggactagtactttacactcctacactactacgacgacgacncctaggacctacgaccttaggtaagtttacgtttacgaacctttaaactttacgttaacgtttacgaacgtaaaaccgttcggtaaaccttaaccggttaccgggtttaccggaaaccgggttacccgggttaaccggggtaacccggaaaacgggggtaaacccgtaaaggggttaaacggaaaaaccgttacggtaaaaacccgtaaggttaccggtacggtacgtacggaaccctacgttacgtttcccg

SEQ ID NO: 339388 - DNA, 610 bp, Homo sapiens
  misc_feature: GZ8MTXP02HIMVP.39.28.C06.1.454.CMB.2.raw
  modified_base (272)..(272): a, c, t, g, unknown or other
  misc_feature (272)..(272): n is a, c, g, or t
tcagtcgcactagtcacgaccggtgctcgatttagagctcacgtattgggtttggggcaggagtcagacccagtcaggacacagcgtggacatgagggtcccgctcagctcctggggctcctgctgctctggttcccaggttccagatgcgacatccagatgacccagtctccatcttccgtgtctgcatctgtaggagacagagtcaccatcacttgtcggcagtcagggtattagcagctggtagctggtatcagcagaaaccaggaacncccctaagctcctgatctatgctgcatcctagtttcgacgtaaagtcggggtaccccccagtccgaaaggttccaagttccggacaggttggggaacttaccgtggggaaccaaggtactttttaccacttctaccaccctatccaagctacgcctgccgaacgccgttagaacgtattttacgactaaactttacgtaattcgactaacaggtactaacctgtttacccgaaggtaccgttacgggaccctaaaagggtacccgaaaggtacggaaaacgttaccgaaaacggtaaccgtttggaccggtacttacggcctaaccgtacgtttaccg

SEQ ID NO: 339389 - DNA, 754 bp, Homo sapiens
  misc_feature: GZ8MTXP02IPX43.39.28.C06.1.454.CMB.2.raw
  modified_base (276)..(276): a, c, t, g, unknown or other
  misc_feature (276)..(276): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggctcccaggtgccaaatgtgacatccagatgacccagtctccttcaccctgtctgcatctgtaggagacagagtcaccatcacttgccggcagtcagagtacttaatagcgtggttggcctggtatcgagcaagaaaccgagggaaacncccctaagcctccgtggtctcgtgtcgcctcctagtttgactaaacgggtcggggtacccctagtacgtaaaggtttccgaggtcccggtacgtaagttacgaaacgttcgtacggggaactacggtaaactttcgaaaccttcctacccgaaacctacttaccgaacgggtaacctaaaccggttcgaccgtaacgtcccggttagggttagtttaacttttacggtaaccttaaacgtttacgttaccgtacgtacccgtaagtacccttaacttacctttaaacttaaccccgtttaaccctttacgttaaccggtttttaccgggaccggtaaacgggggtaaccctaaacggtaccgttaaggtaacgtaaacgttaaaccgtaaaaacggtacgttacgggtaaccggttaccgtaacggtaaaacccgtaccttacgtaccggtttacgttaccgtttaaccgtttacccg

SEQ ID NO: 339390 - DNA, 636 bp, Homo sapiens
  misc_feature: GZ8MTXP02H37HR.39.28.C06.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagtcgcactagtcacgaccggtgctcgatttagagctcacgtattgggtttggggcaggagtcagacccagtcaggacacagcgtggacatgagggtccccgctcagctcctggggctcctgctgctctggttcccaggttccagatgcgacatccagatgacccagtctccattcttccgtgtctgcatctgtagganacagagtcacatcacttggcgggcgagtcagggttatagcagcgtggttagctggtatcagcaagaaacgaggaaacncccctaagctctgatctatgctagcactctagtttacgacgtaaaggtcggtccccagtacgtaaggtcagtcggactgtgaatcgaggtacagtactttcacttcacacatcgacgtcacgcctgaccacgtacgtagtaaacgttacttttagaaccttaacgtttacttacgttacgtaaccgaaacggtaccggttaacttaaacccggttacggtttaacccccgggaaagggtttacccggtttaacccgggaacccggaaaacggggtaacccggtaaaaggttaaacggaaaacctacgaaaaccgtaacgtacggtacgacgttacgaccctaaacgttacgttaccg

SEQ ID NO: 339391 - DNA, 642 bp, Homo sapiens
  misc_feature: GZ8MTXP02JR6R9.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcacatcacttggcgggcgagtcgaagggtattagcagtcgtggttacgccgtggtatcagacaagaaaccgagggaaccgacccctaagcctccgtagatctatgctgctatccgtagtttacgacgtaaagggtcgggtacccaagtacgtaacggttcagtcggacgtaggtgagtcgtagggaactagtactttccactcctacaccatacagcacgcgtacgcaacgtcgtaagtaagttactttacgacctttaaatttactattacggtaaccaaacgtaacgtaaccgttaaaccgttaccggtttacccggaacgggttaaccggtaccgggaacgtaaaacggggaaccgtaaagggtacggtaaaactacgaaaaccgtacggtacggtacgaacgtacgaaccgtactacgttctaacgttctttaccg

SEQ ID NO: 339392 - DNA, 714 bp, Homo sapiens
  misc_feature: GZ8MTXP02FVTBP.39.28.C06.1.454.CMB.2.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggtattagcagtctggttagcctggtatcagcaagaaaccgagggaaacncccctaagctctgatctatgctgactatccgtagtttgacgtaaaggtcggggtaccccctagtacgtaaaggtttcagtccggactaggtggacttacggtaggggaacctaggtactttcctaaccttcctacccaaccctaattacgaacgtcccgaacggtcccgttcggacccgtacgacccgttaaggtaaaacgttagttttttacggaacctttaaaaccgttttaaccgttaactttacggtaaccctaaaacgtacgggttaaaccttaaaccggttaaccgggttttaccccggaaaggggttacccggttaccggggaaacccgtaaacgggggtaaacccgtaaaggggtaacgtaaaacgtaccgtaaaaacggtaacgttacggacggtacgtacggaccctaacctagtttaccg

SEQ ID NO: 339393 - DNA, 619 bp, Homo sapiens
  misc_feature: GZ8MTXP02JGLBI.39.28.C06.1.454.CMB.2.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (434)..(434): a, c, t, g, unknown or other
  misc_feature (434)..(434): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagganacagatcaccatcacttggcgggcagtcagggtatagcagtctggtancctggtatcagacaagaaaccgagggaacnccctaagctacngatctatcgctgactacgtccgtaagtttcgaacgtaaacgggtccggtacccaagtacgtaacggttcagttccggagtaggtacggattcgggtagggaactagttacttacactttcaccaaccctataccacgaccagtcccgtnaccggtaacgtacctaaggtaattacgtttacgaaacttaagttacttatacgtaacaaacgtacggtacctaacgttaccgggttacgaggtaccgtaccgaacggaaacgggtaacgtaagggtaaacgaaaactaccggaaacgtacggtgtaacggctacgactacgacttctacgtctac

SEQ ID NO: 339394 - DNA, 638 bp, Homo sapiens
  misc_feature: GZ8MTXP02F8Q3R.39.28.C06.1.454.CMB.2.raw
  modified_base (195)..(195): a, c, t, g, unknown or other
  misc_feature (195)..(195): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatccacgttggtcgggcgagtcgagggttattagcagtctggttagcctggtatcgagcaaagaaaccgaagggaaacgcccctaaagcctcctgacttctatcggctgctacttccgtaggtttcgaacgtaaacgggtcggggtaccccagttacgtaacgggtttacacgttacggcgtaaggtcgggtatcggtaggggaactaggttactttcactctacgacctagtacagcacgcctaggaccacgtccgttagtaaacgttactttacgaacctaactttactaagttctaacaaacgtacgtaacgttactacggttacccgaggtacgttacggaacgtaaacgggaacgtaaaggtacgaaaacgtacgaaacgtaacgtcggtagccgtacgactaccgtattacctcgttacctttacc

SEQ ID NO: 339395 - DNA, 658 bp, Homo sapiens
  misc_feature: GZ8MTXP02INVLJ.39.28.C06.1.454.CMB.2.raw
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcgagggtattagcagctggttagcctggtatcagcaagaaaccgagggaaacgcccctaagctcctgactctatgctgcatcctaggtttacgcgtaaaggtcggggtacccccagtctaaaggtcagtccggcaggtgtactcgtagggaactgtactttcactcctacaccgatcgacgcacggtcctacgcgacgtacctagtaaagttacttttacggtaccttaaactttacgttaacgtttacgtaacctaaacgtacggtaacccgttaaacgttaccggggtttaaccgaaccggggtttaccggttaacccggaaaccggaaacgggtaaacccggtaaaggggtaacgtaaaaccgttaacggaaaaccgtaaacgtcgggtacggtaccgttacgacccgtaaccttaacggtttccg

SEQ ID NO: 339396 - DNA, 663 bp, Homo sapiens
  misc_feature: GZ8MTXP02I6RVQ.39.28.C06.1.454.CMB.2.raw
  modified_base (286)..(286): a, c, t, g, unknown or other
  misc_feature (286)..(286): n is a, c, g, or t
tcagtcgcactagtcacgaccggtgctcgatttagagctcacgtattgggtttgggggcaggagtcagacccagtcaggacacagcgtggacatgggggtccccgctcagctcctggggctcctgctgctctggttcccaggttccagatgcgacatccagatgacccagtctccatcttccgtgtctgcatctgtaggagacagagtccaccatcagttggcggcgagtcgagggtatagcagcgtggtagccgtggtatcgagcaacgaaaccgagggaaaccnccccgtaagcctccgtagtatctagcgactcgactactcctagtttacgaacgtaaaggtccggggtaccaacgttacgtaacggttacgacgtcggacgtagggtgggtactcggtaggtacgtagttactttcctactaccgactaccaactcgaacgcgtacgccctaggaccctagtaccgtagttaaacggttcttttaacgacccgtttaaattacgttacgttaacgtaaccgtacgtaacggtaccttaaacggttcgttacccggtaaggtacccggtacgggaacggtaaacgggaaccggtaaaggtaacggtaaactacgtaaacgtacgtcggtacgacgtacgacctacttcgtacgtttacc

SEQ ID NO: 339397 - DNA, 585 bp, Homo sapiens
  misc_feature: GZ8MTXP02HBL7D.39.28.C06.1.454.CMB.2.raw
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagagtcaccatcacttggtcgggcgagtcgagggtattagcagctggttagccgtggtatcagcaagaaaccgaagggaaacgcccctaagcctcctgatctatgctgcatccgtagtttcgacgtaaaggtcggggtacccagtacgaacggttcagtcggcgtaggtggatcgtgggacagtattcgactctaccacatcancacgcctgacngctagattntttacgacttaaacttacgttattacgactaaacgtcggtaactaacgtacggtttcccggaaggtaccggttacggaaccgtaaacgggaccgtaaagggttaacgaaaactaccgaaaacgaacgtggtacgcgtacgacctactactcggttctactacc

SEQ ID NO: 339398 - DNA, 559 bp, Homo sapiens
  misc_feature: GZ8MTXP02GK719.39.28.C06.1.454.CMB.2.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttcgngtctgcatctgtagganacagacgtcaccatcacttggcgggcagtcagggttattagcagctggtagctggtatnagcagaaaccagggaacncccctaagctcctgatctangctgcatcctagtttgacaaaggttggggacccctagtcaaggttcagtcggcngtggatcgtgggaacagtactttcactctacacatnagcagcctgcagctagaatatttagactaactttaactatttacgacaaactacggtactaacgtacggtttacccgaggtaccgttcggaaccgtaaacgggaaccgtaaagggtacgtaaaactacgtaaaacgaacgtaggacggacttacggactaaccgctttaccg

SEQ ID NO: 339399 - DNA, 601 bp, Homo sapiens
  misc_feature: GZ8MTXP02FXHFT.39.28.C06.1.454.CMB.2.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggcgggcgagtcgagggtattagcagctggtanctggtatcagcaagaaccaggaaacnccctaagcctcngatctangctgactatcctagtttgaacgtaaagggtcgggtacccagtacgaacggttcacgtcggacaggtggatcggagggactagtacttcactctacacctatcagtcacgtcctagcacgtctagtaaacgttactttagaaccttaaactttactagttactaacgaaacgacggtaccttaaacgttcggtttaccggaggtaccggttacggaacggtaaaacgggacctaaaggggttaacgaaaacgtacgaaaacggtaacgtgtacggaactacgacctaccgtattccgttacgtacctttac

SEQ ID NO: 339400 - DNA, 561 bp, Homo sapiens
  misc_feature: GZ8MTXP02JWN5A.39.28.C06.1.454.CMB.2.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttgtcggcgagtcagggtattagcagctggttagctggtatcagcaagaaaccgagggaaacncccctaaagctcctgactctatgctgctatcctagtttgacgtaaaggtcggggtacccccagtacaaggttcagtcggcgacgtggatcgtagggactagtatttacactctaccactactcaagctagcctgcagccgtagaagttatttcgactaacttactatacgtacgaacaggtacctaacgtacgttcccggtagtacggttaccggacgaaacgggaccgtaagggacgaaataaccgaaagtaacgtggtacgacgtagacacgtacttcg

SEQ ID NO: 339401 - DNA, 692 bp, Homo sapiens
  misc_feature: GZ8MTXP02H8LRX.39.28.C06.1.454.CMB.2.raw
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
  modified_base (427)..(427): a, c, t, g, unknown or other
  misc_feature (427)..(427): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccattcttccgtgtctgcatctgtaggagacagagtcaccatcacttggcgggcagtcgtagggttatagcagcgtggtanctggtatcgaagcaacggaaaccgaagggaaaccnccccgtaagccttccgtagactctatgctgctattccgtagtttcgaacgtaaacggtcgggacccctagtacgtaacgtcacgtcggacgtagtcgggtatcggtagggaactgtaatttccaccttctacacctanaccgagcacgtcctagcctagtacctaggtaacgtttacgtttacgtaacctttaaacttagttaacgtttaacgaacccgtaaaagtaccggttaaacgtttaaacccggttaccgggtttaaccccggaaaacggggtttcccggttaaaacccggggacggaaaaaccggggtaaccggtaaagggttaaaacggtaaaacgtccggtaaaaaacggtaacggttcgggaggtaccaaccggtacctaaacggttcttaacg

SEQ ID NO: 339402 - DNA, 669 bp, Homo sapiens
  misc_feature: GZ8MTXP02I4KH3.39.28.C06.1.454.CMB.2.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagagtcaccatcacttggtcgggcagtcagggtattagcagctggtancctggtatcagcaagaaaccagggaacncccctaagctcctgatctatgcngcatcctagttcgacgtaaacggtcggggtaccccaagtacgtaaggttccaagttccggactacggtggaacttcggtaggggaactaggtactttccaacttctaccaacctataccagactacggtcctacgaccgaacgtccgttaaggtaaacgtttacgttttacggaacttaaaccttttaacgttagttaccggtaacctaaacgtacgggtaacttaaacggtacggtttacccggaacgggttaaccgttaccggggaaccgtaaacggggtaaaccggtaaagggttaaacgggaaaacctaccgaaaaacggtaacgttacggacgtaccgttacgacctaaccgtacgtttccg

SEQ ID NO: 339403 - DNA, 560 bp, Homo sapiens
  misc_feature: GZ8MTXP02JBYU8.39.28.C06.1.454.CMB.2.raw
  modified_base (271)..(271): a, c, t, g, unknown or other
  misc_feature (271)..(271): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggtagcctggtatcagcagaaaccagggaaancccctaagctcctgatctatgctgcatcctagtttgcaaaggtggggtcccatcaaacggttcagtcggcagtcggatcgtgggacagattcactctcaccatcagcagcctgccagcctagaatattttgactaaacgtttacttattacgtactaaacgaggtacctaaacgtacggtttacccgagggtaccgtttacgggacccaaaacgggggaccgtaaagggtacgaaaacgttaacgaaaacgtaacgtgtagggcctagaccacctatctagtactttcg

SEQ ID NO: 339404 - DNA, 640 bp, Homo sapiens
  misc_feature: GZ8MTXP02IPE0B.39.28.C06.1.454.CMB.2.raw
  modified_base (121)..(121): a, c, t, g, unknown or other
  misc_feature (121)..(121): n is a, c, g, or t
  modified_base (253)..(253): a, c, t, g, unknown or other
  misc_feature (253)..(253): n is a, c, g, or t
  modified_base (337)..(337): a, c, t, g, unknown or other
  misc_feature (337)..(337): n is a, c, g, or t
  modified_base (566)..(566): a, c, t, g, unknown or other
  misc_feature (566)..(566): n is a, c, g, or t
tcagtcgcactagtcacgaccggtgctcgatttagagctcacgtattgggtttgggggtctcagagaggagccttagccctggactccaaggcctttccacttggtgatcagcactgagcncagaggactcaccatggaattggggctgagctgggttttccttgttgctattttagaaggtgtccagtgtgaggtgcagctggtggagtcgtgggggagcttggtccagccgtgggggtccctgagctctcngtgcagcctctggattcaccttaggactattggatgagttggtccgcgaggctgcgaggggagggctggaggtgggtcgccaanagtaggaggtagagtggaaagagaagaaattactagtggtaggactctagggtaggaacggggtcccgtaattccaacctatccgtacccagaacgaaccaaacggacccaaaagtaaacttcaacttagtttaaactttaaacctaaaatagtaaaccgaagtacccctaggaacggacggacccggaacggactaccggtcttacggtaacttagttacgtttaggngggaccggggaaagggggctagggtaaggcggtcggggctacgggtcggggaccggaaccggggtaacccccgg

SEQ ID NO: 339405 - DNA, 680 bp, Homo sapiens
  misc_feature: GZ8MTXP02H2Q06.39.28.C06.1.454.CMB.2.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcacatctacgttggcgggntagtcgagggtatagcagctggtagcctgtancagacaagaaacgaggaacnccctaagctactgactactatgtctcgactacttaccgtagtttacgacgtaaagggttccgggtaccccctaagtaccgtaaggttccacgtcgggacgtgggttacgtaacttccgggtagggtaacctagtactttaccgaccttactaccactagtaccgacgactacgcctacgacgtacgtacgttaagtaacgtttaacttttacgaacctttaacttacttaacgtacgtaacaaacgttacggtaaccttaaaccggttacggtaccggtaacgggtacccgtacggggtaaaccgaaacgggtaaccggtaaaaggttaacgaaaaccgttaaaccgaaaacggttaacgtacggttaaccgacgtaccgaaccttaccgtaactttccgg

SEQ ID NO: 339406 - DNA, 545 bp, Homo sapiens
  misc_feature: GZ8MTXP02I9W5T.39.28.C06.1.454.CMB.2.raw
  modified_base (357)..(357): a, c, t, g, unknown or other
  misc_feature (357)..(357): n is a, c, g, or t
  modified_base (419)..(419): a, c, t, g, unknown or other
  misc_feature (419)..(419): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggtattagcagctggtagcctggtatcagcaagaaaccagggaaacgcccctaagcctcctagactctatgctgctatcctagtttgcgtaaagtcggggtacccccatcgaaggttcagtcggcnggtggatcgtaggggactagatttcactctcactatcagcagcctagccagcctagaacgtntttacgactaacttactattcgtacaacaggtactaacgtgtttaccgaggtacgttacgggacctaacggggaccaaagggtacgaaaactcgaaaacgctaggtaggactggacaccgtatacg

SEQ ID NO: 339407 - DNA, 553 bp, Homo sapiens
  misc_feature: GZ8MTXP02HYMB2.39.28.C06.1.454.CMB.2.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (393)..(394): a, c, t, g, unknown or other
  misc_feature (393)..(394): n is a, c, g, or t
  modified_base (403)..(403): a, c, t, g, unknown or other
  misc_feature (403)..(403): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccattcttccgtgtctgcatctgtagganacagatcaccatcacttgcgggcagtcagggtatagcagctggttagcctggtatcgagacaacgaaaccgagggaaacncccctaaagtcctacctgatctatgctgctatccgtagttgacgtaaaggtcgggtaccccatcgaaggttcagtcgcaggtgatcgtggganagtatttcactctacacnncagcacgcngcagtctagtagttattttacgacttaacttatacttagactaaagtcgtacttaaacgtcgttaccgaaggtcgttacggacgtaaacggacgtaaaggtacgaaacgtacgaaaacgtaactcggtacgactacgaccacgtacttcg

SEQ ID NO: 339408 - DNA, 552 bp, Homo sapiens
  misc_feature: GZ8MTXP02IIKLW.39.28.C06.1.454.CMB.2.raw
tcagtcgcactagtcacgaccggtgctcgatttagagctcacgtattgggtttgggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtcccctgagactctcctgtgcagcctctggattcacctttaggactatggatgagttggtccgccaggctgcgagggaggggctgggagtgggtggccaacagtaggaggtagagtggaagagagaaatactagtgtggactctggtggaagggccgattcgaccatctaccagagaccaacgaccaaagattcacttgtaatttaacaaatagaacagcctagagagcgagacacgtctagtatactagttgtagacggaaagggggcaggtggcgtgggctacggtcgggaccgacggggtaaccccg

SEQ ID NO: 339409 - DNA, 622 bp, Homo sapiens
  misc_feature: GZ8MTXP02HU5C7.39.28.C06.1.454.CMB.2.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (413)..(413): a, c, t, g, unknown or other
  misc_feature (413)..(413): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtagganacagatcacatcacgttggcgggcagtcgagggttattagctagctgggttacgcctaggtatcagacaaggaaaccgaagggaaacncccctaagcctcctgatctatgctgctatcctagtttgacgtaaaggtcgggtacccccagtcctaaggttccagttcggactgtggtatcggtagggactagtactttcaccttcacacctanacacgcgacgcctcgaccgtacgtaccgtagtaattactttacgaaccttaaactttactagttacgaaccaaagtacgtaactaaccgttaccggttaccggaacggtaccggtacggaaaccgtaaacgggtaaaccgtaaagggtaacgtaaacctaaccgaaacgtaacgttacggtacgtacctacgacctaccgttacgttcg

SEQ ID NO: 339410 - DNA, 634 bp, Homo sapiens
  misc_feature: GZ8MTXP02JQ1AG.39.28.C06.1.454.CMB.2.raw
  modified_base (280)..(280): a, c, t, g, unknown or other
  misc_feature (280)..(280): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcgagggttatagcagcttgggttagccgtggtatcagacaagaaaccgagggaacncccctaagctctgatctatgctgctacttccgtagtttcggacgtaaagggttccggggtacccagttaccgtaaacggtttccagtcgggactaggtaggtactcggtaggggactaggttactttacacttctaccaacctatccagcctagcccgtagccacgtacgtagtaagttacttttacgacctttaaacgttacttattacgacaaaccgtagtaacttaacgtacggtttacccggaggtacccggttacggacccggaaacggaccgtaagggtaacggaaactacgaaaacgtacgtgtacggaacgtcgaacctaccgtattaccgttacgtactttaccg

SEQ ID NO: 339411 - DNA, 656 bp, Homo sapiens
  misc_feature: GZ8MTXP02JTWLZ.39.28.C06.1.454.CMB.2.raw
tcagtcgcactagtcacgaccggtgctcgatttagagctcacgtattgggtttgggggcaggagtcagacccagtcaggacacagcgtggacatgagggtcccccgctcagctcctggggctcctgctgctctggttcccaggttccagatgcgacatccagatgacccagtctccatcttccgtgtctgcatctgtaggagacagagtcaccatcacttggtcgggcgagtcgagggtattagcagctggttagcctggtatcagcaagaaaccgagggaaacgcccctaagctcctgatctatgctgctactcctagtttcgacgtaaaggtcggggtacccccagtacgtaaggttcagtcggacagggtggatcgtagggacagtacttcactccacaccatcagacacgtcctgccacgtcctaaggaaagtttattttacgacctttaaacgtttacttaagtttcgaaccgtaaacgtacgggtaaccttaaaaccggtttaccgggtttaccccgggaaacgggttacccgggtttacccgggaaacccggtaaacgggggaaacccgtaaaaggggttacgaaaaacgtaccgaaaaacggtaacgtgggtaaccggacgttacgaccctaaccgtacgtttacccg

SEQ ID NO: 339412 - DNA, 623 bp, Homo sapiens
  misc_feature: GZ8MTXP02GZWS6.39.28.C06.1.454.CMB.2.raw
  modified_base (226)..(226): a, c, t, g, unknown or other
  misc_feature (226)..(226): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcatttggcgggngagtcgagggtattagcagcgtggttagccttggtatcagacaagaaaccgagggaaacgcccctaagctcctgatctatgactgactacgtcctaggtttacgacgtaaaggttccggggtcccctaagtaccgtaacggttcagtcggactagggtgtagtccggtagggactagtactttcaacgtctacaacccagtaccaagcaacggtccacgacgacgtacgtacgtaaagttatttacgtactaactttaacttacttactacgtaacgtaacgtacgtaacgttacgttacggtacggtacggtacggtaccgaacggtaacggaacggtaacggtaaacgtaacgtaaacgaaaccgtagtacgtacgtacgactaccgtacttacg

SEQ ID NO: 339413 - DNA, 650 bp, Homo sapiens
  misc_feature: GZ8MTXP02G1KSD.39.28.C06.1.454.CMB.2.raw
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (385)..(385): a, c, t, g, unknown or other
  misc_feature (385)..(385): n is a, c, g, or t
tcagtcgcactagtcacgaccggtgctcgatttagagctcacgtattggggtttgggggcaggagtcagacccagtcaggacacagcgtggacatgagggtccccgctcagctcctggggctcctgctgctctggttcccaggttccagatgcgacatccagatcgacccagtctccattccttccgtgtctgcatcgtgtaggagacagactcaccatcacgttggcgggcagtcgagggttatagcagtctggttacnctggatcagcaagaaaccgagggaaaccncccctaagcctaccgtagactctancgctgacctacttccgtaggtttacgacgtaaacgggttccggacccctagtacgtaagttcagtcggacnggggtcgagtcggtaggactagttacttaccacttaccaccacagtaccaaggctacgccgtagacctacgtccgtaaagtattacgtttccaaactttaactttacgtattacgacgaacgtacggtaccttaaccggtacggttacccgaacgggtaccggttaccggaaacggtaaaccgggtaacgaaacgggtaacggtaaaacctaaccggtaaaagtaacggttacggcggtacccacgtaccctaacgtctttaccg

SEQ ID NO: 339414 - DNA, 738 bp, Homo sapiens
  misc_feature: GZ8MTXP02JN6C8.39.28.C06.1.454.CMB.2.raw
  modified_base (188)..(188): a, c, t, g, unknown or other
  misc_feature (188)..(188): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (578)..(578): a, c, t, g, unknown or other
  misc_feature (578)..(578): n is a, c, g, or t
tcagtcgcactagtcacgaccggtgctcgatttagagctcacgtattgggtttgggggcaggagtcagacccagtcaggacacagcgtggacatgagggtccccgctcagctcctggggctcctgctgctctggttcccaggttccagatgcgacatccagatcgacccagtcctccattcttccgtntctgcatctggtaggagacagacgtccaacctatctacttggtccgggacgagtcgaggggttattacggctaggtcgttagggttacgccgttaggtactcgaacgaccaaacggaaaacccggaacggggaaaccacccccgttaaagtcccttccgtagtatcctaagtcgtctcgtacctacttaccgttaggtttaggacgtaaacggggtccggttacccccagttaccgtaacggtttccaggttcggacgtagggtacggtatccggtagggactaagttacctttacgacttcctaccaacctanaccgaancctacgtcgtacgacgtacgtacgtaagtactttacgtttacaccgttaactttagttattaccgtaanacccgtaggtactttaaaccggtaccggtttaccgggaacggtttaccggtaccggaaaccgggtaaaacgggtaacccggtaaaggttaaaccggaaaacgtaaccgaaaaggttaacgttacggtacggtacctacggaacccttacgtacgtttccg

SEQ ID NO: 339415 - DNA, 695 bp, Homo sapiens
  misc_feature: GZ8MTXP02HOCL6.39.28.C06.1.454.CMB.2.raw
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgagggttattagcagctggttacgccgttggtatcgagcgaacgaaaccgaagggaaacgcccctaagcctcctgatctatgctgctatcctagtttcgactaaaggtcgggtaccctagtaccgaggttcagtcggctaggtcggatcggtaggggtacagttactttcctaacgtcctaccaccgtataccgacgccacgtcctgccgtacgtaccgtaggtaaagtttacgttttacgaacctttaaacctttaacgtttagttacgtaaaccgtaaacgtacggttacccgttaaaaccggttaccgggtttaaccccgggacgggttaacccgggtttaccgggaacccggtaaaacgggggtaaaccggttaaagggtaaacggtaaaacgtaacgaaaaccggtaccgttaggtacggaaccgtacaccgtaacctacgttcggttacctttctttaacccg

SEQ ID NO: 339416 - DNA, 545 bp, Homo sapiens
  misc_feature: GZ8MTXP02I67U4.39.28.C06.1.454.CMB.2.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagtcgcactagtcacgaccggtgctcgatttagagctcacgtattggggtttgggggcaggagtcagacccagtcaggacacagcgtggacatgagggtccccgctcagctcctggggctcctgctgctctggttcccaggttccagatgcgacatccagatcgacccagtctccattcttccgtgtctgcatctggtaggagacagntcaccatcattgtcggngatcgaggtatagcagtctggttancctggtatcagacaagaaaccagggtaacncccctaagctctagctctatgcctagctagtcctagtttcacgaaaggttcggtaccccataccgaaggtttcagtcgctagggtgacttcgagggtactagttactttaccactctacacctagcngactcgctcgcancgtagtagtattatacttacttacttactactataataattaacttcttactctctactacgttacggtcggtacggacgacgtagacgtacgtaacgtaacgaacgtcgtgtacgcgctacc

SEQ ID NO: 339417 - DNA, 680 bp, Homo sapiens
  misc_feature: GZ8MTXP02F87BY.39.28.C06.1.454.CMB.2.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagtcgcactagtcacgaccggtgctcgatttagagctcacgtattgggtttgggggtcagacccagtcaggacacagcgtggacatgagggtccccgctcagctcctggggctcctgctgctctggttcccaggttccagatgcgacatccagatgacccagtctccatccttccgtgtctgcatctgtagganacagactcacctatcacgttggtcgggcgtaggtcgaaggggttattaggctagtcgttggtacgcgtggtatcagcaaagaaaccgagggaaacncccctaagcctcctgtactctatgctgctatccgtagttacgacgtaaacggtcgggtacctagtacgtaacggttacacgtcggactaggtcggtactcggtacgggaactagttaactttcgtactctacaacctatcgaacgcgaacgtccgtaggacctacggtacctaagggtaaattcggttttaacaacctttaaactttaaccgtttatttaccggtaacgtaaacgtaaccgactttaaacggtccggtttaccgaagggtacccgttaccggaaacgtaacggggaacgtaaaggggtacgaaaacgtaaccgtaaaacgtaacgttgtaacggccttacggaaccctactaccgttacgtaccgtttctttaacccg

SEQ ID NO: 339418 - DNA, 652 bp, Homo sapiens
  misc_feature: GZ8MTXP02HT42G.39.28.C06.1.454.CMB.2.raw
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
tcagtcgcactagtcacgaccggtgctcgatttagagctcacgtattggggtttgggggtcagacccagtcaggacacagcgtggacatgagggtccccgctcagctcctggggctcctgctgctctggttcccaggttccagatgcgacatccagatgacccagtctccatcttccgtgtctgcatctggtaggagacagacgtcacctatcacgttggtcgggcagtcgagggttatagcagtctggtagcctaggtancagacaagaaccgaggaaacncccctaagcctctagactctatcgactcgactacgttccgtagtttacgacgtaaaggtccgggtacctagtacgtacgtcacgtacgcgtaggtgattcggtagggactaagtcctttacgacctactcgaaccntacgagacgtacgtaccgtacgacgtacgtacgtaagtacgttactttacgtaaactttaactttaacgtttacgtacgttaactaacggtacgttaaccttaaccggttaccggttaccggaacggttacccggtaacggaacggtaaacggtaacggtaaaggtaaacgtaaacggtacgtaaacgtacgtaggtacgtcgtacgactacgttacgttacttcgtttactcg

SEQ ID NO: 339419 - DNA, 664 bp, Homo sapiens
  misc_feature: GZ8MTXP02IYJQ9.39.28.C06.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (390)..(390): a, c, t, g, unknown or other
  misc_feature (390)..(390): n is a, c, g, or t
  modified_base (451)..(451): a, c, t, g, unknown or other
  misc_feature (451)..(451): n is a, c, g, or t
tcagtcgcactagtcacgaccggtgctcgatttagagctcacgtattggggtttgggggcaggagtcagacccagtcaggacacagcgtggacatgagggtccccgctcagctcctggggctcctgctgctctggttcccaggttccagatgcgacatccagatgacccagtctccatcttccgtgtctgcatcgtgtaggacgacagacgtcaccatcacgttggcgggcgagtcgagggtattagcagtcgtggttagcgtggtactnagacaaacggaaaccgaggggaaaccncccctaagcctcgtagactctagtgtctgctactccgttagtttacgaacgtaaacggttcgggaccccctagtacgtaggttcagtaccggngtaggtcgtatccggtaggacctaagtcttacactccgtacaccagtcagcacgtctcganacgtcttaggtaaacttctttaagacctttaaactttcgtacttacgtaacgaaagtacgtaaacgtttacgtaaccggtttaccgggtaacgggttaacggttacccggggaaacggaaacggggtaaacccgtaaaagggttacgaaaaaccgtacccgtaaaaagggtaacgtcggtagggtaccctagtacccgtaaccttacgtttcg

SEQ ID NO: 339420 - DNA, 830 bp, Homo sapiens
  misc_feature: GZ8MTXP02F8JBI.39.28.C06.1.454.CMB.2.raw
  modified_base (550)..(550): a, c, t, g, unknown or other
  misc_feature (550)..(550): n is a, c, g, or t
tcagtcgcactagtcacgaccggtgctcgatttagagctcacgtattgggtttgggggcaggagtcagacccagtcaggacacagcgtggacatggagggtccccgctcagctcctggggctcctgctgctctggttcccaggttccagatgcgacatccagatcgaccagtctccatcttccgtgtctgctatctggtaaggagacagagtaccaccatcgtacgttggtcgggcgtaagttcggaggggttatacgcgtagtcgttaggttacgtccgtaggttactacgagacgaaacggaaaaccggaaggggaaacctacccccgtaaggtcccttaccgtacgtacttacttaacgtcggtctacgacctacgttaccgttaaggtttacggaaccggtaaaacgggttccggggtaaccccctaacgtaacggtaacggttccgaacgtaccgggtacgacgggttaccgggtagttaccgggtaagggtaaccgtaaggttacctttacctaaacccttccgtaacccgtacctaaacggtnaaccggtaccgtaaccgttacccggcgacccgtacgtaaccggttaaggttaaaaccgtttaagttttaacccgtaacttaaacgttttaaacccgttagttaaccgtaaccgtaaaacggtacggtaaaacccgtaacgtttaaccgggttaccgggtaaccggtacggggttaaacccgaccgggtaaaacggtaaaccggtaaagggtaacgtaaaacggaaccgtaaaacggtaacgttacggttacggacttacggaccgttaactacgtttccg

SEQ ID NO: 339421 - DNA, 583 bp, Homo sapiens
  misc_feature: GZ8MTXP01BTHRD.52.30.C08.1.454.CMB.2.raw
  modified_base (251)..(251): a, c, t, g, unknown or other
  misc_feature (251)..(251): n is a, c, g, or t
  modified_base (385)..(385): a, c, t, g, unknown or other
  misc_feature (385)..(385): n is a, c, g, or t
  modified_base (465)..(465): a, c, t, g, unknown or other
  misc_feature (465)..(465): n is a, c, g, or t
  modified_base (543)..(543): a, c, t, g, unknown or other
  misc_feature (543)..(543): n is a, c, g, or t
tcagcgcagtacgacacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaaatgacattggtgttataattntgtctctgtaccaacaccaccaggcaaacgcccccaaatcattatttatggtgtcggtcgaccggccctcgaggggtttcgaatcactttctctggctccaagtccccggcaacaccggcctccctagaccctntctctgggcctccgagggccgaggacgaggctgattattactgcgtctcatataaccaaacaacaaacgtaattggggtnttacgggcggaaggacccaagccgtcgtacccgtactaggtccaacggtcccaagggtccttcgccccctgggttccncgttccttcgtccccgcccttctcttactaacgcgttccg

SEQ ID NO: 339422 - DNA, 558 bp, Homo sapiens
  misc_feature: GZ8MTXP01C8I1Z.52.30.C08.1.454.CMB.2.raw
  modified_base (453)..(453): a, c, t, g, unknown or other
  misc_feature (453)..(453): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaaatgacattggtgttataattatgtctctggtaccaacaccaccagcaaagccccaaactcattatttatggtgtcggtgaccggcctcagggggtttcaaatcacttctctgctcccaagtcgcaacacggcctccctgaccatctctgggctcagggccaggacgaggctgattattactgcgcctcaataataacaaaacaacaaacaaattggggtnttcgggcggaaggggaacccaaaggctagacccgtctaagggtcaggccccaaaggcctcgcccccgttggccaactctcgttccccacccttcctcaataaccg

SEQ ID NO: 339423 - DNA, 599 bp, Homo sapiens
  misc_feature: GZ8MTXP01DM5MK.52.30.C08.1.454.CMB.2.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaatgacattggtgttataattangtctctgtacacncaccagcaaagccccaaatcattatttangtgtcggtgaccggcctgaggggtttcaatcactttctctggcttcccaagtccggcaacgcggccctccctgaccatctctcggactcgaggcccgaggacgaggctgtattattactgccgcttacataactacaaaacgaacaacgtaaagttggggtacgttcggacgggagggaaccaagtccttacgaccgttccgttaagggccaacggccccgaaagggccttccggccccccgttcgggttaccaaccttccttccgtttccccaccccttcctttaaccttaacgttaacccg

SEQ ID NO: 339424 - DNA, 637 bp, Homo sapiens
  misc_feature: GZ8MTXP01DP5HJ.52.30.C08.1.454.CMB.2.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (588)..(588): a, c, t, g, unknown or other
  misc_feature (588)..(588): n is a, c, g, or t
  modified_base (613)..(613): a, c, t, g, unknown or other
  misc_feature (613)..(613): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcacgtggaaaccgaatgactagttggtagttaataattntgtctctgtaaccaacaccaccaggacaaacgccccaaatctattattanggtgtcggtcgaccgcctcgtagggtttcaatcacttctcnggtcctccccgaagtccgacaaccgaccggtccctcccngacctactcctcgtgggcctcggaggcccgaggacgnggtactgtattaatcgtcgcncttanaataactaaccgaaaacaaactaacgtaagtttcggggtacgtacgggcgggaaggaaacccgagtcctacggaccgttccgtaaggtccgaacgccccgttaagggtccctccggttccccccgttggttaacccncctttcctccccgtttaaccccccncccttcttaaccgttaacgtaacg

SEQ ID NO: 339425 - DNA, 607 bp, Homo sapiens
  misc_feature: GZ8MTXP01BNQ9B.52.30.C08.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagcgcagtacgacacgaccggtgctcgatttagtctgacgtcaaagggaaaggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactggaaccgaaatgacattggtagttataattntgtctctgtaccaacaccaccagcaaagccccaaatcattattatggtgtcggtnaccggccctgtagggggtttcaatcacttctctgctcaagtccccggcaacgcgcctccctanacccntctctgggcctcgaggccgaggcgaggctgatttatactgaccgtctacataaactaacaaaacaacgaactaaaggtttggggttacgttacgggcgggaagggacccaaaggtccgttcgaacccgttcctaaggggtccaacgggtcccaaagggccttccgggcccccttgggttaccttaccgttccttccggttccccaacccttccctcttactaaccggttaatcccg

SEQ ID NO: 339426 - DNA, 566 bp, Homo sapiens
  misc_feature: GZ8MTXP01ANCL7.52.30.C08.1.454.CMB.2.raw
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (506)..(506): a, c, t, g, unknown or other
  misc_feature (506)..(506): n is a, c, g, or t
tcagcgcagtacgacacgaccggtgctcgatttagtctgacgtcaaagggaaaggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccntctcctgcacgtggaaaccgaaatgactattggtagttataattntgtctctggtaccacnccaccaggacaacgccccaatcattattatggtgtcggtgaccggcctgacggggtttcaatcacttcnctggctcgaagtccccggacaacncggccctcacgaccntcncgtggctcgagccgagacagctgattntactcgctctacattacaacaaacgtacaagtaagttcggggtntcggacggnggaccagcgtcgccgtaccgagggtcaacgccccgaagggtcccncccgtcccgtcgttccgttccttccgtccctcccctccttctacgttactcgttcgtccg

SEQ ID NO: 339427 - DNA, 725 bp, Homo sapiens
  misc_feature: GZ8MTXP01D0CTT.52.30.C08.1.454.CMB.2.raw
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcacatctctgcataggaacgaatgactagttggtagttaataattntgtctcgtagtaaccaacaccaccagaccaaacgcccaaatcattattagtggtntcggtcgaccgtctggtagggttcaatctacttctcgtaggtcctacccgaacggtccggactaaaccgccggtaccccttccctgaaccctagtccgtcgtcggggaccctcggacggaccggtaaggacgtacggctaggtaatttacgtacgtcggtcctacctactaacttaaactaaaacccaaaactaaaacgtaaacggttaaacggtttacgggggttacgtttacccgggggacgggtaaacggaacccgtaaacggtccgtacgtacccggtttacccgaaagggttcccgaacggccccgttaaacggtcccggttccccgttaccccccgttcggttacccaaccccgtttccggttccccgttacccccctaccctttaccgttaacccttaacgtaacccgg

SEQ ID NO: 339428 - DNA, 656 bp, Homo sapiens
  misc_feature: GZ8MTXP01B2UI5.52.30.C08.1.454.CMB.2.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (305)..(305): a, c, t, g, unknown or other
  misc_feature (305)..(305): n is a, c, g, or t
tcagcgcagtacgacacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcatcaccatctctgcacgtggaaaccgaatgaactagttgggtagttataattntgtcctctcggtaccaacaccaccagacaacgccccaatctattatttanggtgtcggtcgaccgcctgtaggggtttcaacgtcctacttctcgtcggctacgacgtcccggacctaacgccgcccgtcctacgaccctcgttccgtcgtcgggccctacggacgggacggacgggacgacggcttgtactttagtacgtcgcctacctactaattaactaaaccaaaacaaacctaaaggttacggtttacggggtacggttaccggggaccgggaaacggtaaccaggttaccgtacggtaccccgtacgttacgggccaacgacccgagggtccttccgccccgtcgttcttccttccgtaacctcccctaacccttctacttaccgtaacgcgtcg

SEQ ID NO: 339429 - DNA, 652 bp, Homo sapiens
  misc_feature: GZ8MTXP01DAQPL.52.30.C08.1.454.CMB.2.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (422)..(422): a, c, t, g, unknown or other
  misc_feature (422)..(422): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaatgacattggtgttataattatgtctctggtaccaacaccaccaggcaaacgccccaaatcattatttatggtgtcggtnaccggcctcgtaggggtttcaatcacgttctctggctcaagtccccggacaacncggcctccctagacccntcctctggggacctccgacgggccgacggacgaggctggattnttacgtgcgtcctcatactaacaaaactaacaaacgtaaagtttggggtagttacgggcggtaacgggacccgtaaaggtccgtaggtacccgttccgtaaacgggttccaacggaccccgaaaggtcccgttccggtacccccgtcggggttcccacggtttcccttcgggtttcccccccggtccccttttacccgtcccgtttaacttaaccgttaacgtttcccgg

SEQ ID NO: 339430 - DNA, 638 bp, Homo sapiens
  misc_feature: GZ8MTXP01B9R6V.52.30.C08.1.454.CMB.2.raw
  modified_base (252)..(252): a, c, t, g, unknown or other
  misc_feature (252)..(252): n is a, c, g, or t
  modified_base (444)..(444): a, c, t, g, unknown or other
  misc_feature (444)..(444): n is a, c, g, or t
  modified_base (616)..(616): a, c, t, g, unknown or other
  misc_feature (616)..(616): n is a, c, g, or t
tcagcgcagtacgacacgaccggtgctcgatttagtctgacgtcaaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcagtggaaaccgaatgactattgggtagttatattntgtctctgaccaacaccaccagacaacgcccccaaatctatttattagtggtcgtcggtcgaccgtcctacgtagggttcatctacttctcgtcgtctcgaacggtccccgactaacgccgtccctcccacgacctgtcctccggtcgggcctacggacgggcccggaggacgaggtctagtattactacgngtcctactcaataaactaacgaaaacaaccgaaagttaggttggggtacgtcggacggaacgggaccaaggtccgacggtaccgtacgtaggtcccgaacgccgaacggtccttccggaacccccgttggttaccttccgttcccgttaaccggtccccctccctttaccgngttaccctcgttaagtccccgg

SEQ ID NO: 339431 - DNA, 682 bp, Homo sapiens
  misc_feature: GZ8MTXP01C3UB6.52.30.C08.1.454.CMB.2.raw
  modified_base (497)..(497): a, c, t, g, unknown or other
  misc_feature (497)..(497): n is a, c, g, or t
  modified_base (654)..(654): a, c, t, g, unknown or other
  misc_feature (654)..(654): n is a, c, g, or t
tcagcgcagtacgacacgaccggtgctcgatttagtctgacgtcaaaggggaaagggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacagtcgatccaccatcctctgcagtggaactggaaatgactagtttggtagttaattaattgtcgtctcgtacgtaaccaacacccaccgaggacaaaccgaccccaaatctatttattagtggtgtcggtcgacccggtccgttaggtagggtttacattcacgttctcgtcggctaccgaacggtcccggacaaccgacccggtccctaccccgtagaaccctactcccgtacggtcgggaccctacggacgggaccgaggacgacggtctagtattacgtacgtcgacgtacctanaactaaactaaacaaaccaaagtaaactaagttagaggttcggtacgggacgggtaacggaacacgtcgtacggtaccgtcgtaacggcgaaccggacccgaagggtccctcccggttcccccgttgggacccttaacgtcccgttccggttccccncccgtttacctaacgttaaccgtaaccg

SEQ ID NO: 339432 - DNA, 563 bp, Homo sapiens
  misc_feature: GZ8MTXP02F50G2.52.30.C08.1.454.CMB.2.raw
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagcgcagtacgacacgaccggtgctcgatttagtctgacgtcaaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaaatgacattggtgttataattatgtctctggtaccaacaccaccaggcaaacgcccccaaatcattatttatggtgtcggtgaccggccctgaggggtttcaatcacttctctggctccaagtccccgcaacncgcctcctgaccntctctgggcctccgaggccgaggacgaggctgattatactgcgctcatactaacaaaacaacaaactaaagtttggggtagttccgggacggaacggggacccaaggcctaggacccgtcctaggtcacgccccaaaggcctcgccccctcggtcactccgtcgttccccacctcctctataccgactcg

SEQ ID NO: 339433 - DNA, 588 bp, Homo sapiens
  misc_feature: GZ8MTXP02GHZG0.52.30.C08.1.454.CMB.2.raw
  modified_base (255)..(255): a, c, t, g, unknown or other
  misc_feature (255)..(255): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccgaatgacattggtgttaataattntgtctctggtaccaacaccaccaggacaaacgacccccaaatcaattatttatggtgtcggtgacccggcctcgagggtttcgaatctacttcgtctcggctcccaagtcccggacaaaccgaccggccctccctgacccattccgtccgtgggctaccgacggcccgaaggaccgaggctaggtatttactacgtgcgcctacgattaaacaacaaaacaactaactaagttgggtgtacgggcggaggtaaccaagctagaccgtctacggtcacgccaacggctaccgccccgtcgcaaccttcgtcttaccccacctcctactactacg

SEQ ID NO: 339434 - DNA, 553 bp, Homo sapiens
  misc_feature: GZ8MTXP02H6RDB.52.30.C08.1.454.CMB.2.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (551)..(551): a, c, t, g, unknown or other
  misc_feature (551)..(551): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccgaaatgactagttggtagttataattntgtctctgtaccacacaccagcaacgccccaaatcattattatggtgtcgtgaccgcctgtagggtttcaatcacttctntggctcaacgtcccgacacgcgcctcctgacccntctctcggctccgaggccgaggacgagctagtatttactactgctcctcaatactaaacaaaacaacaaactaagtttggtacgtcgggacgggaggaaccagcgtacgaccgtacgtagtcacgaccgaacggctaccgccccgtacgtcctactctccgttcccaccttctctactacgtcncg

SEQ ID NO: 339435 - DNA, 531 bp, Homo sapiens
  misc_feature: GZ8MTXP02FSNBR.52.30.C08.1.454.CMB.2.raw
  modified_base (457)..(457): a, c, t, g, unknown or other
  misc_feature (457)..(457): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctctggtaccaacaccaccaggcaaagcccccaaatcattatttatggtgtcggtgaccggcctcgaggggtttcgaatcacttctctggctcccaagtccgcaacacggcctcctgaccatctctgggctccgaggccgaggacgaggctgattatactgcgcctcatatacaaacaacaacaattgggtattcggngagggaccaagctagaccgtctaggtcagcccaaggctcgcccctggtcnctcncgttcccacctcnctatacg

SEQ ID NO: 339436 - DNA, 553 bp, Homo sapiens
  misc_feature: GZ8MTXP02F6702.52.30.C08.1.454.CMB.2.raw
  modified_base (372)..(372): a, c, t, g, unknown or other
  misc_feature (372)..(372): n is a, c, g, or t
  modified_base (449)..(449): a, c, t, g, unknown or other
  misc_feature (449)..(449): n is a, c, g, or t
tcagcgcagtacgacacgaccggtgctcgatttagtctgacgtcaaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaaatgacattggtgttataattatgtctctggtaccaacaccaccaggcaaagcccccaaatcattattatggtgtcggtgaccggcctgaggggtttcaatcacttctctgctccaagtccccggacaacacggcctcctgaccntctctgggcctccgaggccgaggacgaggctgattatactgcgctcatataacaaaacaacaaactaagttggggtnttacgggacggaagggaccaagctgaccgtccgtaggcacgcccaaggcctacggccccctcggtaccactcctcgttccccacccttctactactacgatccg

SEQ ID NO: 339437 - DNA, 607 bp, Homo sapiens
  misc_feature: GZ8MTXP02GHGC6.52.30.C08.1.454.CMB.2.raw
  modified_base (440)..(440): a, c, t, g, unknown or other
  misc_feature (440)..(440): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgtgtctcctggacagtcgatcaccatctcctgcactggaaccgaaatgacattggtgttataattatgtctctgtaccaacaccaccagacaaacgcccccaaatcatttattatggtgtcggtgaccggccctcgaggggtttcaatccacttctctggccctaccgaagtccggacaaacaccggccctccctgaccatcctcgtgggcctccgaggcccgaaggtaccgaggctagtattattactgcncctcaataactaaacaaaaacaaacgaaactaaagttggggtacgttcggggacggaagggaaccaaggctacgaccgtctacggtacacggacccaaacggccgtaccgcccccgtcggtaacctaccttcctccgttaccccctaacccttccctacttaaaccg

SEQ ID NO: 339438 - DNA, 621 bp, Homo sapiens
  misc_feature: GZ8MTXP02H24S4.52.30.C08.1.454.CMB.2.raw
  modified_base (255)..(255): a, c, t, g, unknown or other
  misc_feature (255)..(255): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (443)..(443): a, c, t, g, unknown or other
  misc_feature (443)..(443): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacgagggtcctgggcccagtctgccctgactcagcctgcctccgtgtctgggtctctggacagtcgatcaccatctctgcacgtaggaaccgaatgactagttggtagttatatntgtctcgtgaccaacaccaccagacaaacgccccaaatcatttattagtggtgcgtcgaccgtcctgtagggtttacaaattcacttctcgtcggctaccccgaacgtccgacaacgaccgccttccngacctatccngtcggcctacgacggccaggacgagtctagattagtactcgcctccgtanaactaacaaacaaaaccaaactaagtagttcgggtacggtacgggaacggaacggaacgacgtccgtacggacccgtacgtacggaccgacggaccgtacggcccgtacccgaccccgttacgtaccctaaccgttcccgttacccgttaccccctaccttacctacgttaacgtccg

SEQ ID NO: 339439 - DNA, 606 bp, Homo sapiens
  misc_feature: GZ8MTXP02JJW8E.52.30.C08.1.454.CMB.2.raw
  modified_base (364)..(364): a, c, t, g, unknown or other
  misc_feature (364)..(364): n is a, c, g, or t
  modified_base (428)..(428): a, c, t, g, unknown or other
  misc_feature (428)..(428): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccggaatgacattggtgttataattatgtctctggtaccaacaccaccaggcaaacgcccccaaatcatttatttatggtgtcggtgaccggtcctgaggggtttcaatcacttctctgctcccagtccgcaacnccgcctccctgaccatcctcgtgggctccgaggcccgaggacgaggctgattatactgcgcctnattaacaacaaacaacaacgtaagttggggtagttcgggacgggtagggaccaaggctacgaccgtccgtaggtaccgaagtcccccgaaaggtcctcccggtaccccccgttcggtaccctaaccgttcccgttaccgttaccccccaccctttcccttacctaccgttaaacccgg

SEQ ID NO: 339440 - DNA, 628 bp, Homo sapiens
  misc_feature: GZ8MTXP02IF78S.52.30.C08.1.454.CMB.2.raw
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccgaatgacattggtgttataattatgtctctgtaccaacaccaccagacaaacgccccaaatcaatttatttatggtgtcggtgacccggcctcgagggtttcaatcacttctctggctcccgaacgtccggacaacgacggtccctccgtgacctatccgtcgtcgggcctccacgggaccgaggaccgaggtctaggtactttagttactgccgtctacaataactaaacaaacaaactaaacgtaagtttacggggtacgttccgggacgggaacgggaaccgaaaggtcctacggacccgttacgtacggtacacggccctaaagggtccctaccgtacccccgtacggtcctaaccgtcgttaccgttccccctacccttccttactactaaccg

SEQ ID NO: 339441 - DNA, 561 bp, Homo sapiens
  misc_feature: GZ8MTXP02ICYCI.52.30.C08.1.454.CMB.2.raw
  modified_base (248)..(248): a, c, t, g, unknown or other
  misc_feature (248)..(248): n is a, c, g, or t
  modified_base (338)..(338): a, c, t, g, unknown or other
  misc_feature (338)..(338): n is a, c, g, or t
  modified_base (373)..(373): a, c, t, g, unknown or other
  misc_feature (373)..(373): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccgaatgacattggtgttatattangtctctgtaccaacaccaccaggcaaacgccccaaactcattattatggtgtcggtgacccggccctcgaggggtttcgaatcactttcnctggctccagtcccggacacacggcctcctgaccntcctctcgggcctccgaggccgaggacgagctgattatactgccgtctacatactacaaaacaacaaactaagttgggtagttcgggacggaggaccaagctacggaccgtccgtaggcacgacccgaaggcctcgcccccgttggtacctacttctccgttcccgcccttctcgtactacgactccg

SEQ ID NO: 339442 - DNA, 737 bp, Homo sapiens
  misc_feature: GZ8MTXP02IXPXZ.52.30.C08.1.454.CMB.2.raw
  modified_base (248)..(248): a, c, t, g, unknown or other
  misc_feature (248)..(248): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccgaatgacattggtgttataattntgtctcgtgtaccaacaccaccagacaacgaccccaaatctattattagtggtgtcggtacgacccggcctacgtagggtttacatcctacttctcgtcggtcctaccgtaacgtccccggacctaaccgacccggtccccttccccgtacgtaaccctacgttccgtcggtccgggtcccttacccggacgggacccggaacggggacccgtaagggtcccttaggtaactttagttaccgtcgcccgtacctactaacttaacaaacctaaaaccaaactaaacgttaaggtttcggggtacggttacggggaccgggaacggaccgtaaacggtccgtacggtaaccccgtacgttacgggtaaccacgggacccgaacgggtcccgtccccggtaaccccccgttcgggtaaacctccccgtttcccgttcccgtttaccccccgtacccgttccttaacccgtacttaaaccggtcttacccgg

SEQ ID NO: 339443 - DNA, 605 bp, Homo sapiens
  misc_feature: GZ8MTXP02IBB7J.52.30.C08.1.454.CMB.2.raw
  modified_base (310)..(310): a, c, t, g, unknown or other
  misc_feature (310)..(310): n is a, c, g, or t
  modified_base (422)..(422): a, c, t, g, unknown or other
  misc_feature (422)..(422): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccgaatgactagttggtgttataattatgtctctgtacaacaccaccaggcaaacgccccaaatcattattatggtgtcgngaccggcctgagggtttcatcactctctggctcccagtccggacaacgacggccctccctgaccctatcctcgtcgggcctcgacggcccgaggacgagctagatttatacngccgctacatactaacaaacaaactaacgtaagttggggtacgttcgggacggaaggaccaaaggtcctacggtaacccgtccgttaaggaccacggaccccgtaaagggtccctcccggccccccttggtaccctaaccgttccgtaccgttcccccgcccttcccgttacttacgtaaccg

SEQ ID NO: 339444 - DNA, 577 bp, Homo sapiens
  misc_feature: GZ8MTXP02IMMD6.52.30.C08.1.454.CMB.2.raw
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (331)..(331): a, c, t, g, unknown or other
  misc_feature (331)..(331): n is a, c, g, or t
  modified_base (417)..(417): a, c, t, g, unknown or other
  misc_feature (417)..(417): n is a, c, g, or t
  modified_base (550)..(550): a, c, t, g, unknown or other
  misc_feature (550)..(550): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaaatgactagttggtagttatattntgtctctgtaccacaccaccagcaacgccccaancattatatgtgtcggtgaccgcctgagggtttcgaatctacttcnctgcctacacgtccccgacaaacgcggcctccctgaccatctcgcggcctccgaggccgaggacgagctagattatactgcgctanatactaaacaaaacaacaaactaaagtttgggagttacgggacgggaacggggaccaaaggctacgacccgtcgtaaggcacgacccgaaggcctccggaccccctggaccctactccgttccggttaccccnccccttactcctacttaccgatcccgg

SEQ ID NO: 339445 - DNA, 630 bp, Homo sapiens
  misc_feature: GZ8MTXP02IVDB7.52.30.C08.1.454.CMB.2.raw
  modified_base (301)..(301): a, c, t, g, unknown or other
  misc_feature (301)..(301): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgaatgacattggtgttaataattatgtctctgtaccaacaccaccagcaaacgccccaaatcattatttanggtgtcggtcgaccgcctgaggggtttcaatcacttctcgtggctcccaagtccgacaaccgacggccctcctgaccactctctggggctccgaaggcccgaggacgacggctagtaatttacttacgtgaccgtacctactaataactaaaccaaaacaaaactaaacgtaaacgtttggggtacgttccggggacggaacgggaacccgaaagcgtacggtaccgtcccttaaagggcaacggacccgaaacgggcctaccgcccccgttcggtacctaacgtccgttccgtttaccccacccgtttacccttactaacgttaaccg

SEQ ID NO: 339446 - DNA, 659 bp, Homo sapiens
  misc_feature: GZ8MTXP02FL6NI.52.30.C08.1.454.CMB.2.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgcagtggaaccgaatgactatttgggtagttataattntgtctctgtaccacaccaccagcaacgccccaatcattatagtggtgtcggtcgaccggcctcgtagggtttcaactctacttctcgtgcctaccgaagtcccccgaccaacgaccggcccttcccgtacgacctactcctcgtcgggcctccgacgggccgaggacgaggtctagtaactttacttacgtcgaccgtacctactaacttaaacaaaccaaaacctaaacctaaacgttaacggtttggggttacggttacggggaccgggtaaacggaccgacgtacgtaccgtacccgtaccgtacggaccacgacccgaagggtccctccgccccccgttaggtaccctaccgtccgttaacccgtaccccctacccttccctactacctacggtacttccgg

SEQ ID NO: 339447 - DNA, 693 bp, Homo sapiens
  misc_feature: GZ8MTXP02JKKDO.52.30.C08.1.454.CMB.2.raw
  modified_base (258)..(258): a, c, t, g, unknown or other
  misc_feature (258)..(258): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtggaaaccgaatgactagttggtgttataattntgtctctggtaccacaccaccagcaacgccccaaatcattatttatggtgtcggtgacccggcctcgtagggttcgaatctacttctctggtcctacccgaacgtcccggacaaccgaccggtccctccctgaccctatcctcgtcgggctccgacgggaccgaggacggacgcgtagtaactttattacgtcgtcgtcctactacttaaacaaccaaaaccaaactaaaccgtaaagtttcgggggtacgtttacggggaccgggaacgggaaccgtaaacggctacggtaacccgtccggtttaaacggtccgacggaccccgaaacgggtcccgtacccggtacccccccggttcgggttaacctaacccgttacccgttcccggttacccccctaaccccgttccccttaaccgttaacctttaaccccgg

SEQ ID NO: 339448 - DNA, 663 bp, Homo sapiens
  misc_feature: GZ8MTXP02GUACK.52.30.C08.1.454.CMB.2.raw
  modified_base (250)..(250): a, c, t, g, unknown or other
  misc_feature (250)..(250): n is a, c, g, or t
tcagcgcagtacgacacgaccggtgctcgatttagtctgacgtcaaaggggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcagtggaaccgaatgactagttggtagttatattntgtctctgtaccacaccaccagacaaacgccccaatctattattagtaggtgtacggtcgacccggtcctggtaggggttcaatctacttctcgtcggtcctaccgtaacgtccccggaccaaccgacccgggtccctcccgtacgaaccctattcccgtcggttccggggacctacccggaacgggccccggaaagggaccggacggtctagtaatttacgttaacgtcggaccctccttacaacttaaacaaaccaaaacgaaactaaaccgtaaggtttggggtacggttaccggggacggaaacggtaccaaagtcgtacggaccgtcgtaacggcacggaccacggccgtaccgccccctggtaccctcgttcctccggttcccccaccttccactactcgatcccgg

SEQ ID NO: 339449 - DNA, 608 bp, Homo sapiens
  misc_feature: GZ8MTXP02HBLLZ.52.30.C08.1.454.CMB.2.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (395)..(395): a, c, t, g, unknown or other
  misc_feature (395)..(395): n is a, c, g, or t
  modified_base (561)..(561): a, c, t, g, unknown or other
  misc_feature (561)..(561): n is a, c, g, or t
  modified_base (576)..(576): a, c, t, g, unknown or other
  misc_feature (576)..(576): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgcacgtggaaccgaatgactagttggtagttataattntgtctctgtaccaacnccaccagacaaacgccccaaatcatttattatggtgtcggtcgacccggcctcgagggtttcatctacttctactggtcctcccgagtcccggacaaaccgcggtccctccgtcgaacctntcctcgtcgggactccggaacggcccgaaggaccgagtcgtagtaatttaacttcgtcgctacctacaattaaacaaaccaaaacaaccgtaaaataacgttggggtacgttacggaccgggaaggaacccaaggctacggaacctcgtacgacacggaccagtcncccgccctaggaccnccgtctccttcccaccttccgtactaactccg

SEQ ID NO: 339450 - DNA, 679 bp, Homo sapiens
  misc_feature: GZ8MTXP02GUWDJ.52.30.C08.1.454.CMB.2.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacngtcgatcaccatctcctgcacgtaggaaaccgaatgactagttggtagttaataattntgtctctgaccacaccaccagacaacnccccaatcatttattagtggtcgtcggtcgacccgtccgtgtagggtttcaatcctacttctcgtcggtcctaccccgacgtccgactaaccgccgtcccctacctcgacctatccgtcgtcgggtcctaccgacgggaccgacggaccggagggtaccttagtaatttacgtaccgtcggaccctacctactaataaacctaaaccaaaaacgaaactaaagttaaacggttgggggttacgttaccggggacgggtaaacggaaccgtaacggcgtaccgtaccgtacgtacggtacgaccgaccgaacggtcccgtacccgtccccgtacggttacctcccgttcccttcccgtaccccctccccttaccttacccgtaacgtaccg

SEQ ID NO: 339451 - DNA, 540 bp, Homo sapiens
  misc_feature: GZ8MTXP02FF988.52.30.C08.1.454.CMB.2.raw
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (460)..(460): a, c, t, g, unknown or other
  misc_feature (460)..(460): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (531)..(531): a, c, t, g, unknown or other
  misc_feature (531)..(531): n is a, c, g, or t
tcagcgcagtacgacacgaccggtgctcgatttagtctgacgtcaaagggaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtgttataattatgtctctggtaccaacaccaccaggcaaagcccccaaatcattatttatggtgtcggtgaccggccctgtaggggtttcaatctacttcnctggctcccagtccgnaacncggcctcctgaccatcncgtggctccaggccgaggacgaggctgattactactgccgtcctcattacaacaaacaactaaacattgggtgttcggnggtagggaccaaggcngaccgtcaggtcagcccaggcncgcccccnggtcaactctcgtcccgcccttccnctactaacg

SEQ ID NO: 339452 - DNA, 574 bp, Homo sapiens
  misc_feature: GZ8MTXP02FXMVR.52.30.C08.1.454.CMB.2.raw
  modified_base (214)..(214): a, c, t, g, unknown or other
  misc_feature (214)..(214): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (489)..(489): a, c, t, g, unknown or other
  misc_feature (489)..(489): n is a, c, g, or t
  modified_base (552)..(552): a, c, t, g, unknown or other
  misc_feature (552)..(552): n is a, c, g, or t
tcagcgcagtacgacacgaccggtgctcgatttagtctgacgtcaaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggaccagtcgatcaccatcncctgcacgtggaaaccgaatgactagttggtgttaatattatgtctctggtaccaacaccgaccaggcaaacgcccccaaatcagtttattactggtgtcggtgaccggcctagacggggtttcaattcgacttctctgctcgaagtcccgacacacgctcngacntcncgtggcctcaggccgagacnggctgaattntagtcnccgtctaanacgtaacaaacaaactaactaagttaggggtacgttgacggggagacccgagtcaggtacnccggtaagtcgagaaccctcggagtccgacccgttccgtcgtactcgttccaaccgttacccncttacgacttaacgcctcgacg

SEQ ID NO: 339453 - DNA, 832 bp, Homo sapiens
  misc_feature: GZ8MTXP02I7CSK.52.30.C08.1.454.CMB.2.raw
  modified_base (314)..(314): a, c, t, g, unknown or other
  misc_feature (314)..(314): n is a, c, g, or t
tcagcgcagtacgacacgaccggtgctcgatttagtctgacgtcaaagggaaagggggctgggggtctcaggaggcagcgctctcgggacgtctccaccatggcctgggctctgctattcctcaccctcctcactcagggcacagggtcctgggcccagtctgccctgactcagcctgcctccgtgtcgtggtctccgtggacagtcatccaccatctcctgcacgtggaaaccgaatgactagttggtagttaataattatgtctcctaggtaccaacacccaccaggacaaacgccccaatcatttattagngtgtcggtcgccgcctgtacggggttcaagtctacttctcgtggtccttacccgacgtccgacaaacgtacggcccccttccctacgtaccacttccgtccgtacgggtccgtaccgacgggtcccggacgggaacccggagggtcccttaaggtaatttacggtttaacctcgggtaccccgtacctacctaaagtttaaacaaaaaccccgtaaaaactaaaaccgtaaacgttaaacgggttttacggggggtttaaccggtttaccgggggaaccgggggtaaaccggggttaaaccccggaaacggggtaccccgtttaacgggggaaacccccgtttaaccccgggtaaaccggggtttacccaaccgggggaaacccccggtaaacccggggttccggttaaaccccccggtccccccggtttccgggggtaacccctcccggtttacccgttacccccggggttcccccctaacccccggtttcccttaaccgtttaacccgtaacccgg

SEQ ID NO: 339454 - DNA, 684 bp, Homo sapiens
  misc_feature: GZ8MTXP02IJHJU.52.30.C08.1.454.CMB.2.raw
  modified_base (458)..(458): a, c, t, g, unknown or other
  misc_feature (458)..(458): n is a, c, g, or t
tcagcgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcagtggaacgaatgactattggtagttataattatgtctctagtaccaacaccaccagacaaacgccccaaatcatttattatggtgtcggtcgaccgtcctcggtagggtttacaattcacttcgtctcggcctacccgaagtccgactaaccgacggtcccctaccgtcgaacctacttcctccgtcgggcctaccgagggacccgagggaccgaggtcctagtactttagtaccgnggtacccacctactaacgtaactaaacccaaaactaaacctaaagtaaggtttcggggtacggttaccgggacgggaaacggaccgtaaggccttacgggaccccgttacggtaggaccctaaccgggacccaaacgggtcccgtacccgccccccggttagtaccctaaccgtttcccgtacccgttacccccgacccctttcccgtaaccgttaacgtaacccg

SEQ ID NO: 339455 - DNA, 591 bp, Homo sapiens
  misc_feature: GZ8MTXP02GLA8I.52.30.C08.1.454.CMB.2.raw
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
  modified_base (453)..(453): a, c, t, g, unknown or other
  misc_feature (453)..(453): n is a, c, g, or t
tcagcgcagtacgacacgaccggtgctcgatttagtctgacgtcaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccgaatgacattggtgttataattatgtctcctggtaccaacaccaccaggcaaacgcccccaaatcattattatggtgtcggtnacccggcctgaggggtttcaatcacttctctgctccaagtccccgacaacacgcctccngaccntcctcgtggcctccgaggcccgaggacgaggctgtaattattactgctcctanataacacaaaactaacaactaagttggngttacgggacggtaagggaccaaggtccacggtaccgtaccgtaggtcccaacggtaccccaaagggcctccggcccccctcgggtaccacttccgtaacgtttcccccacccttcctacctacgtaccgtactaccg

SEQ ID NO: 339456 - DNA, 439 bp, Homo sapiens
  misc_feature: GZ8MTXP01DBGIU.4.60.F05.1.454.CMB.2.raw
  modified_base (401)..(401): a, c, t, g, unknown or other
  misc_feature (401)..(401): n is a, c, g, or t
  modified_base (433)..(439): a, c, t, g, unknown or other
  misc_feature (433)..(439): n is a, c, g, or t
tcagagcactgtagcacgaccggtgctcgatttagtacgtcatcagggaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcaccgtctcctcagcctccaccaaggcccatcggtcttccccctggcgccctgctcccaggacgcacctccgagacgcccacagccggccctggggcctgcctggtcaaaggcctactcccanagtgctctgagcgggctggcaaggcgcatagnnnnnnn

SEQ ID NO: 339457 - DNA, 435 bp, Homo sapiens
  misc_feature: GZ8MTXP01EY4KW.4.60.F05.1.454.CMB.2.raw
  modified_base (429)..(435): a, c, t, g, unknown or other
  misc_feature (429)..(435): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgtcaagaacacggtgtatgtgcaagtgaccagcctgagagtcgaggacacggccgtgtattactgtgcgaaggcctttgccccaaagtggatatagtggctaactttgactactggggccagggaaccctggtcaccgtctcctcagcctccacaagggcccatcggtctcccctgcgccctgctccaggagcacctccgagagccacagccggccctggggctgccctggtcaaggctacttccctacagtcgctctgagcgggctgggcaagggcgcatagnnnnnnn

SEQ ID NO: 339458 - DNA, 480 bp, Homo sapiens
  misc_feature: GZ8MTXP01DYIVW.4.60.F05.1.454.CMB.2.raw
  modified_base (329)..(329): a, c, t, g, unknown or other
  misc_feature (329)..(329): n is a, c, g, or t
  modified_base (470)..(470): a, c, t, g, unknown or other
  misc_feature (470)..(470): n is a, c, g, or t
  modified_base (473)..(480): a, c, t, g, unknown or other
  misc_feature (473)..(480): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactacgtgggccagggaccctggtcaccgtctcctcacgcctccaccaacgggccccatccggtccttcccccgnggcccgccctgcctcccgaggacgccaccctccgagacgccacgagccggcccgtgggctcgcccgtgggtaccaaagggtaccttaccttcccctacagtcgcctcgtggacggccggggcgtcgggacaagggcgacanagnnnnnnnn

SEQ ID NO: 339459 - DNA, 462 bp, Homo sapiens
  misc_feature: GZ8MTXP01BCAB9.4.60.F05.1.454.CMB.2.raw
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (451)..(453): a, c, t, g, unknown or other
  misc_feature (451)..(453): n is a, c, g, or t
  modified_base (455)..(462): a, c, t, g, unknown or other
  misc_feature (455)..(462): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactacgtggggccagggaaccctggtccaccgtctcctcagccctccacgaacggcccagtccgtcctcccccgnggccncctgcctcgaggcncacctcgagcncccacnggccgccctggctcgccgtggacaaggtcctaccttcccanaggtcnctacgtggacggccgggntacgggcaagggccanagtgnnngnnnnnnnn

SEQ ID NO: 339460 - DNA, 449 bp, Homo sapiens
  misc_feature: GZ8MTXP01D8CY0.4.60.F05.1.454.CMB.2.raw
  modified_base (327)..(327): a, c, t, g, unknown or other
  misc_feature (327)..(327): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (441)..(449): a, c, t, g, unknown or other
  misc_feature (441)..(449): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtgatatagtgctaattgactactgggccagggaaccctggtcaccgtctcctcacgcctccaccaagggccccatccggtcttccccctggccnccctgctcccaggcgcacctcgagagcccacagccggccctggggctgccgtggtcaaacggtacctaccttcccctanagtcgctcgtagngcgggctggcaaggcgcatagnnnnnnnnn

SEQ ID NO: 339461 - DNA, 437 bp, Homo sapiens
  misc_feature: GZ8MTXP02FUX9Q.4.60.F05.1.454.CMB.2.raw
  modified_base (432)..(437): a, c, t, g, unknown or other
  misc_feature (432)..(437): n is a, c, g, or t
tcagagcactgtagcacgaccggtgctcgatttagtacgtcatcagggaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccaggggaaccctggtcaccgtctcctcagcctccaccaaggcccatcggtctccccctggccgccctgctcccaggacgccacctccgagagcccacagcggccctgggctgcctggtcaaggacctacttccctacaggctctgagcgggctggcaaggcgcatagnnnnnn

SEQ ID NO: 339462 - DNA, 428 bp, Homo sapiens
  misc_feature: GZ8MTXP02H2S95.4.60.F05.1.454.CMB.2.raw
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
  modified_base (426)..(428): a, c, t, g, unknown or other
  misc_feature (426)..(428): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaagtggatatagtggctaactttgactactggggccaggggaaccctggtcaccgtctcctcagcctccaccaaggcccatcggtctcccctggcgccctgctccaggagcacctccgagagccacagcgcctgggctgcctggtcaaaggctaccttccccanacgtgctctgagcgggctggcaaggcncatagnnn

SEQ ID NO: 339463 - DNA, 452 bp, Homo sapiens
  misc_feature: GZ8MTXP02INBAP.4.60.F05.1.454.CMB.2.raw
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (438)..(438): a, c, t, g, unknown or other
  misc_feature (438)..(438): n is a, c, g, or t
  modified_base (444)..(452): a, c, t, g, unknown or other
  misc_feature (444)..(452): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaacttgactactggggccagggaaccctggtcaccgtctcctcagcctccaccaagggcccatcggtcttccccctggccnccctgctcccaggacgccacctccgagacncccacagccggccctgggcctgccgtggtcaaaggacctaccttccctangttcgcttcngaggcgggctggcaaggccncatagnnnnnnnnn

SEQ ID NO: 339464 - DNA, 466 bp, Homo sapiens
  misc_feature: GZ8MTXP02GD1G8.4.60.F05.1.454.CMB.2.raw
  modified_base (326)..(326): a, c, t, g, unknown or other
  misc_feature (326)..(326): n is a, c, g, or t
  modified_base (418)..(418): a, c, t, g, unknown or other
  misc_feature (418)..(418): n is a, c, g, or t
  modified_base (446)..(446): a, c, t, g, unknown or other
  misc_feature (446)..(446): n is a, c, g, or t
  modified_base (452)..(466): a, c, t, g, unknown or other
  misc_feature (452)..(466): n is a, c, g, or t
tcagagcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccaggggaaccctggtcaccgtctcctcagcctccaccaaggccccatccggtcttcccccnggccgcccctgcctcccaggacgccacctccgaagacgcccactagccggcccctggggcctgcccgtggtcaaaggtacctacttccctanagtcgctctgagcgggctggcaagggcncatagnnnnnnnnnnnnnnn

SEQ ID NO: 339465 - DNA, 545 bp, Homo sapiens
  misc_feature: GZ8MTXP02GO9UF.4.60.F05.1.454.CMB.2.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (499)..(499): a, c, t, g, unknown or other
  misc_feature (499)..(499): n is a, c, g, or t
  modified_base (501)..(503): a, c, t, g, unknown or other
  misc_feature (501)..(503): n is a, c, g, or t
  modified_base (505)..(507): a, c, t, g, unknown or other
  misc_feature (505)..(507): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(519): a, c, t, g, unknown or other
  misc_feature (516)..(519): n is a, c, g, or t
  modified_base (521)..(522): a, c, t, g, unknown or other
  misc_feature (521)..(522): n is a, c, g, or t
  modified_base (524)..(524): a, c, t, g, unknown or other
  misc_feature (524)..(524): n is a, c, g, or t
  modified_base (526)..(531): a, c, t, g, unknown or other
  misc_feature (526)..(531): n is a, c, g, or t
  modified_base (533)..(536): a, c, t, g, unknown or other
  misc_feature (533)..(536): n is a, c, g, or t
  modified_base (538)..(545): a, c, t, g, unknown or other
  misc_feature (538)..(545): n is a, c, g, or t
tcagagcactgtagcacgaccggtgctcgatttagtacgtcatcagggaaaggggctggagtgggtccccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaacggtcctttcgaccccaaagtgatagtagtgctaattgactagtgggccaggacctgcaccgtcncctcacncctccaccgaacggccccagtccgtccctcccccgnggcccncccctgccctaccaggccgacctacccgacgagacgccaccgcgcccgcccgtcggggcctggaccgtcggtaacgtaaacggaccctttaaccttcccccgtacgagtcgtcccttggacggacgggcccggggtacgtacgggaccgtaacgggccaacgaagtagngnnngnnngcgangngnnnngnngncnnnnnncnnnngnnnnnnnn

SEQ ID NO: 339466 - DNA, 551 bp, Homo sapiens
  misc_feature: GZ8MTXP01DX6MC.17.1.A01.1.454.CMB.2.raw
tcagcgtagactagcacgaccggtgctcgatttagacgtctcatctgggggcaggagtcagacccactcaggacacagcatggacatgagggtccccgctcagctcctggggctcctgctgctctggctcccaggtgccagatgtgccatccaaatgacccagtctccatccctccctgtctgcatctgtaggagacagagttaccatcacttgccgggcaagtcagggcattagaaatgatttaggctggatacaaacaaaacgtagggagacgacccctaaactcctgatctatgctgcatccagtttgcagacgtggggtcccatcaaggttcagcggacagtggatcgtggcacagtatttcacttctcaccatcagcacgcctgcagcctagaagtattttcgactaactttattactgtactaactaagtacttacgtacttacccgtcgggtaacgttcggaccgtaaaggggaccgtaaagggtggaacgttattaaccgtaaaacggaaccgtcggtggacttacggtaaccgaaccgtaag

SEQ ID NO: 339467 - DNA, 542 bp, Homo sapiens
  misc_feature: GZ8MTXP01C2944.17.1.A01.1.454.CMB.2.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggatacaaacaaaacgtagggagacgacccctaaatcctagatctatgctgcatcctagttgacagacgtcggggtacccatcgaaaggttcaaggcggacaggtggatcgtagggcacgagtactttcactctacacatcagacacgctgcagcctagaagttattttacgactaaactttataactgttactaacaaagtacttaacgtacttacccgtggtaacgttcggacgaaacgggacctaagggtgaacgttagttacaaaacgatcgtaggcttagccaactaac

SEQ ID NO: 339468 - DNA, 544 bp, Homo sapiens
  misc_feature: GZ8MTXP01DIMUN.17.1.A01.1.454.CMB.2.raw
  modified_base (219)..(219): a, c, t, g, unknown or other
  misc_feature (219)..(219): n is a, c, g, or t
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggnaagtcagggcattagaaatgatttaggctggatacaaacaaaaactagggagacgacccctaaactcctgatctatgctgcatcctagtttgcagactggggtcccatcaaggttcagcggacagtggatcgtggcacagtatttcactctcaccagtcagcagcctgcagcctagaacgttattttcgactaacttattactgtactaanaagtattacgattaccccgnggtaaccgttcggaccgtaaagggaccgtaaagggtaggaagttagttaacgtaaaccgaaagtcggtagggccttaggccgttaacccgtaag

SEQ ID NO: 339469 - DNA, 557 bp, Homo sapiens
  misc_feature: GZ8MTXP01CMCFB.17.1.A01.1.454.CMB.2.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (404)..(404): a, c, t, g, unknown or other
  misc_feature (404)..(404): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctcctgtctgcatctgtagganacagagttaccatcacttgccgggnaagtcaggcattagaaatgattaggctggatacaaacaaaacgtagggagacgacccctaaactcctagatctatgctgcatcctagttgcagacgtgggtccatcaagtcagcggacagtggatcgtggcacagtacttcactctacaccatccaagctacgcctggcacgtcctagtaaagttntttacgacttaactttattactgtactaactaagtacttaacgtacttacccgtcgggtaaccgttcgggacgtaaacggggaccgtaaagggtgggaacttacgttacgtaaaacgtaacgttggtacgggtcttacgccgttaaccgttcg

SEQ ID NO: 339470 - DNA, 541 bp, Homo sapiens
  misc_feature: GZ8MTXP01ELX00.17.1.A01.1.454.CMB.2.raw
  modified_base (219)..(219): a, c, t, g, unknown or other
  misc_feature (219)..(219): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggnaagtcagggcattagaaatgattaggctggatacaacaaaaactagggagacgcccctaaaactcctgatctatgctgcatccagtttgcagacgtcggggtacccatacgaaaggttcgaagcggacagtggatcgtggacacagtattcactctacaccatcagcagctgcacgctagatatttgactaacttatactgtataacaaagtacttaacgtacttaccctcgggtaaccgttacggaccgaaacgggacccgaaagggtacggagacgttaacaaacgaacgtggtacggcgttacaacgttaacccgtaag

SEQ ID NO: 339471 - DNA, 591 bp, Homo sapiens
  misc_feature: GZ8MTXP01EG7YZ.17.1.A01.1.454.CMB.2.raw
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (301)..(301): a, c, t, g, unknown or other
  misc_feature (301)..(301): n is a, c, g, or t
  modified_base (564)..(564): a, c, t, g, unknown or other
  misc_feature (564)..(564): n is a, c, g, or t
tcagcgtagactagcacgaccggtgctcgatttagacgtctcatcaaggaagggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaanccnggaccaacgcccccaggacactgatttanagaataacaaacaaacaaacactcctcgacccctgcccggttctcagcctccgtcggttggggacaagctcgccctcgtcccgtttgggtcgcgtcacgccgtgaggatggaggctagagtattactgtcttcgcttctcttaagtggttgggggttgttcggggttagttcggggacggtaggaccaaggtcgtcgtcccgtcgtacggcaacgcccgaagggtccttccggccccttggccttcttccgttccgttccccncccttctccgttactccgttaacgtcg

SEQ ID NO: 339472 - DNA, 584 bp, Homo sapiens
  misc_feature: GZ8MTXP01C1MKC.17.1.A01.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtcctccatcctcctgtctgcatctgtagganacagtacgttaccatcacttggccggganaagtcagggcattagaaatgatttaggctggatacaaacaaaacgtaggagacgacccctaaatctagatctatgctgctatccgtagttcgcagacgtgggtccagtcgtaagtcaggcgcaagtggatcgtggacacngtacttcacttcacaccgatcagtacncgctgacacgtacgtagtaagttagttactaactttaactttacgttactacgtaactaacgtaaagttacgttaccgtaccgtacccggtacggttaaccggtacggaaccggtaacgggaccgtaaagggtcgttaaacgttacgttaaaccgaaacgtacgtcggtcgtacttacggtaacccttaacgtg

SEQ ID NO: 339473 - DNA, 641 bp, Homo sapiens
  misc_feature: GZ8MTXP01A6T8F.17.1.A01.1.454.CMB.2.raw
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (591)..(591): a, c, t, g, unknown or other
  misc_feature (591)..(591): n is a, c, g, or t
tcagcgtagactagcacgaccggtgctcgatttagacgtctcatcaagggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacatgtcattatccctatgtccaanagaanccnggccaacgcccccaaggaccactgatttangataacaaacaacaaacactcctacggaccccctgcccggttctcacggtcctcccgtcggttcgggggacaaacgcgtcgcccctcgtccccgtttcgggtcgacgcacgtccgtgggacggatcggaggtcgtggaacgttagttactggtcttgtccttctaccgttagttacgtgggggttcggttcggggttggttaccgggcgggtacggaaccaacggtcgttcggtaacccgttcgttaacgggcaacggcccgttaaagggcccttccggtcccccgtcggttaccncgttccctcgttcccccaacccttcctcccgttactcccgttaacgtccg

SEQ ID NO: 339474 - DNA, 616 bp, Homo sapiens
  misc_feature: GZ8MTXP01BQBTV.17.1.A01.1.454.CMB.2.raw
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
tcagcgtagactagcacgaccggtgctcgattttagacgtctcatcaagggaaggaaggggaccaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactgganctgtcacaatggtcattatccctatggttaccaacagaanccnggaccaacgcccccgtaaggaccactcgtatttangataacaaacaacaaacactcctacggacccctgccggttcncaggcctccgtcggtggggacaagctcgccctgcccgttgggcncgcagcctagacgatgagtctagagtattacgngtcttgctctctaagtcgtggggtgtttcgggtgttacgggcggtaacggccgtaaaggccgtcggtacccgtacgtacggggtcaacggtccccgaaagggtccttcccgggaccccctggggtttaccccgttccttcccggtcccttccccgtcccttcccgttacccgttacgttcccgttccgtcg

SEQ ID NO: 339475 - DNA, 727 bp, Homo sapiens
  misc_feature: GZ8MTXP01AFXCI.17.1.A01.1.454.CMB.2.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccataccaaatcgacccagtcctccatccctcctgtctgcatctagtagganacagagttaccatctacgttcggaccgganaagtcgagggctaattagaaatgtagtttaggctaggtataacaaacgaaaacgtgggaacgtaccacccctaaactcctagtactactatcgctagctagtccgtagtttcgacgacgtacgtcgggtacccacgtacgacggttcgaggcggaacaggtcgactcgtacgggactacgagttactttaccaccttcaacctaccagtaccgagtaccgacgttccgacgggaccaccgtacgttaagttaaacggttactttttaaccggaaaccttttaaagtttaaacctttaccgttaggttaaacccttaaaccggttaaaagtttaacccgtttacccgggttaaaccctttaccccgggttaccgggggttaacccggttaaccgggaacccgggtaaagggggttaaacccgtaaggggttaacgggaacgtttaacgaaacgtaaaaccggggctttaaggggcgccgttaccgaacttccgttaaccg

SEQ ID NO: 339476 - DNA, 590 bp, Homo sapiens
  misc_feature: GZ8MTXP01C5E71.17.1.A01.1.454.CMB.2.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (461)..(461): a, c, t, g, unknown or other
  misc_feature (461)..(461): n is a, c, g, or t
  modified_base (541)..(541): a, c, t, g, unknown or other
  misc_feature (541)..(541): n is a, c, g, or t
tcagcgtagactagcacgaccggtgctcgatttagacgtctcatcaagggaagggaaggggaccaggggtcccttccaatatccagcaccatggcctggactcctctctttctgttcctcctcacttgctgcccagggtccaattcccaggctgtggtgactcaggagccctcactgactgtgtccccaggagggacagtcactctcacctgtggctcagcactgganctgtcaccaatggtcattatcccctatggttcaacagaagccnggccaagccccccaggacactgattangatacaaanacaaaanactcctggaacccctgcccggttctcaggctccgtccgttggggganaagctgaaccctgccctttcgggtagcgnacgcctgagatgaggctgagtactattgcttgctctcctagtacgtggggtagttcggggtgtttccgggnggagggccaaaggtctaggtacccgtcctagggttccaaacgcccgaaaggccgttacgacccccgttcgggttaacccnccttccgttcgttcccctaacccttccctcgttacgtccgttaacgtcg

SEQ ID NO: 339477 - DNA, 540 bp, Homo sapiens
  misc_feature: GZ8MTXP02GF9YV.17.1.A01.1.454.CMB.2.raw
  modified_base (396)..(396): a, c, t, g, unknown or other
  misc_feature (396)..(396): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaactagggagagacccctaaactcctagatctatgctgcatccagtttgcagactggggtccatcgaagttcagcggcagtggatctggcacagtatttcacttctcacatcagcagcctgcagcctgaaagtnttttcgactaaactttattactagtactaactaagtacttaaccgtactttacccgtcggtaaccgtttcggaccgaaacggggaccaagggtacgagtaatacgaaaacgtaacgtgttacgggactacggacctaacctacg

SEQ ID NO: 339478 - DNA, 526 bp, Homo sapiens
  misc_feature: GZ8MTXP02GXC1Y.17.1.A01.1.454.CMB.2.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaactaggagacgacccctaaaactcctgatctatgctgcatccagtttgcagacgtcggggtcccatcgaagttcagcggcaggtgggatcgtggacactagatttcactctacacatcagcacgcctgcagcctagaagtattttcgacttaacttattactgtactaacaagtacttaacgacttacccgtacggtaccgttcggacgaacgggaccgaaggtgaacgactacgaaaacgactagacggactcgaccactacg

SEQ ID NO: 339479 - DNA, 600 bp, Homo sapiens
  misc_feature: GZ8MTXP02GF6BF.17.1.A01.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtagganacagacgttaccatcacttcggccggganaagtcagggctaattaagaaatgtatttaggctggtatacaaacaaaacgtagggaagacgacccctaaactcctagatctatgctgcatcctagtttcgcagtacgtcggggtacccatacgaaggttcacggtcggactaggtggatcgtggaccacgagtatttccactcctaccacatcagcacgcctagcacgcctaggtaaacttattttagaaccttaactttagttacctagttactaacaagtaacttaccgtaacttaccccgtcggtaccgtttacgggaacgaaacgggaaccgtaaaggtcgggtaactaacgtaaccgaaaacgttaaccggtggttacggaccgtacggaccctactttacg

SEQ ID NO: 339480 - DNA, 599 bp, Homo sapiens
  misc_feature: GZ8MTXP02HB1LM.17.1.A01.1.454.CMB.2.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (353)..(353): a, c, t, g, unknown or other
  misc_feature (353)..(353): n is a, c, g, or t
  modified_base (574)..(574): a, c, t, g, unknown or other
  misc_feature (574)..(574): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatccctcctgtctgcatctgtagganacagagttaccatcacgttggccgggnaagtcgaggcaattagaaatgatttaggctggtatacaaacaaaacgtaggaagacgacccctaaactcctagatctatgctgacatccctagtttgctagtaccgtcggggtccaacgttacgaacggttnacggtcggacgaggtcggtatcgtgggacaacgtagtactttcaacttcctaccacctatccaagcacgccttacgacgtacgccgtaggaacttagtttacaactaacttttatacttctaactaacgtaagtaacttacgtaacttacccgacggttaccgttacggaccggtaaacggaaccgtaaggacgggtaaactagtaaacgaaacggtaacngggtcggtaaccacgtacctactac

SEQ ID NO: 339481 - DNA, 600 bp, Homo sapiens
  misc_feature: GZ8MTXP02HC1UA.17.1.A01.1.454.CMB.2.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtcctccatcctccctgtctgcatctgtaggagacagagttaccatcacgttggccgggacaaggtcgagggctaattaagaaatgatttaggctggtatacaaacaaaaacgtagggagacgacccctaaaacgtcctagatctatgctgcatccagtttgcagacgtggggtccatcgaagtcagcggacagtggatcgtggacactagtactttcactctacaccagtcgcacgccgtcgacacggacctacgtaaggttaactttagtacgtaaactttaatttacttacgttactaacctaaaggtaacttaacgttaacgttaacccgttaccggtaaccggttaccggttaccggaaacgggacccggtaaagggtacggtagaactacgtaaaacgaacgtacgtcggtactaggtacacccgtattccg

SEQ ID NO: 339482 - DNA, 670 bp, Homo sapiens
  misc_feature: GZ8MTXP02ITY73.17.1.A01.1.454.CMB.2.raw
  modified_base (266)..(266): a, c, t, g, unknown or other
  misc_feature (266)..(266): n is a, c, g, or t
  modified_base (285)..(285): a, c, t, g, unknown or other
  misc_feature (285)..(285): n is a, c, g, or t
  modified_base (381)..(381): a, c, t, g, unknown or other
  misc_feature (381)..(381): n is a, c, g, or t
tcagcgtagactagcacgaccggtgctcgatttagacgtctcatcaaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactgttccaacaganctgccaacgccccaggacnctgatttatgataacaaacaacaaaacactcctcgacccctgcccgttctcagcctcctcggtggggacaagctcgccctcgtcccgtttcgggcnccgcacgccgtggacggtatcggaggctaggagttacgtttactcggtcttcgtcttccgtccgttagttaggttggggtttgggtttcggggttcgggtttcggggaccggggaacgggtaacccgaaggtccgttacggaccccgttaccggtacgggtacaaccgggaccccgaaagggccccttaccggtcccccccgttccggggttaccctaacccgtttcccgttccggtttcccccccggaccctttccccgttacccgttaccgttcccgtaccgtccgg

SEQ ID NO: 339483 - DNA, 289 bp, Homo sapiens
  misc_feature: GZ8MTXP01AIDC7.17.10.A10.1.454.CMB.2.raw
  modified_base (286)..(289): a, c, t, g, unknown or other
  misc_feature (286)..(289): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgcccctcggtcactctgttcccacctcctcctagtctacgctgagcgggctggcaaggcgcatagnnnn

SEQ ID NO: 339484 - DNA, 624 bp, Homo sapiens
  misc_feature: GZ8MTXP01BMUPE.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccatgtggattcaattatgtgtctggtaccagcaactcccggatcacgcccccaaactcctcatatatagaaagataaataagccgaccctcgacggggttcccctggaccgtattctctggctccaagtctggcacgtctcgcccacccgtggcatccaccgcgctccagacgtgggacgaggccgagttatttctggaccgtacaaaccgtgtcggggactttacccgagtcccttagtaccgtttccgggtaaggggggtttcgtttccgggggccgttagggttacgggggtaacccaaacgggttccgttacgggtaaccccggtttcccgtaacggggttcccgacgggacccccgtaaagggttcccgttcccccggg

SEQ ID NO: 339485 - DNA, 617 bp, Homo sapiens
  misc_feature: GZ8MTXP01EIH9N.17.10.A10.1.454.CMB.2.raw
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (437)..(437): a, c, t, g, unknown or other
  misc_feature (437)..(437): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgccccacgccccaggttcagttggtgcagactggggctgaggtgcagaagcctggggcatcagtgactgtctcctgcaaggccagtggatatatcttcacaaaatatggtatgaattgggtgcgacaggccccccgganaagggcttgagtgggtggtgggtgtagnggcgtgttaggacggtagacacgtagtgccgacgaaacgaagagtagggaaacgganaaggtacgacgaactaccgtaaccgaccggaccccaacccccgaagaaccacgtactaccanagtacgaacctagacggaacgacgcgagaggacgtcgaggaccgacggaccggtcctattactacgttgtacgaggtaattacgtttcgtttacggttctaacttaggtaccgttaaaacttgtttgaaaggtcggtccttaacgttaaggccgggttagtcgggtttcccgttcggggg

SEQ ID NO: 339486 - DNA, 725 bp, Homo sapiens
  misc_feature: GZ8MTXP01BMKP0.17.10.A10.1.454.CMB.2.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttanacaaatatggtatgaattgggtgcgacacggcccccggacgaagggctttggaggtggggtgggggtgggtcgaggcgggtcgtttggacgggtaaggcacgagtagtgaccgaccggaagagtaggaaagggcaaggaagtacaaacgtacttaaccccgaacgggaacccaaccccccgaaacgaaacctaaccgaacggtacctaacaacgttcggaacctaaaccgtacggaaccggaacgtaccccgtagggaagacgaccggtaacgggaacccggaaccgaccgggtccccggttaccttaacgtttaccgtacggtttggtaccggtaaggttaaagtttcgtttttaacgttcggttacctaaagttcccggttaaacttaagtttttacggatttaacggggtaaccctttacggtaagtttacggggtaaccgttgggtaacccgtttcggttaacccggggggg

SEQ ID NO: 339487 - DNA, 600 bp, Homo sapiens
  misc_feature: GZ8MTXP01A3AEM.17.10.A10.1.454.CMB.2.raw
  modified_base (251)..(251): a, c, t, g, unknown or other
  misc_feature (251)..(251): n is a, c, g, or t
  modified_base (369)..(369): a, c, t, g, unknown or other
  misc_feature (369)..(369): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctctgctctcgaacccccatgtgatcatatgntctgtacagcactccggatcacgccccaaactcctcatatatgaagataaatacgcgaccctacgtacgggttcccctggaccgtattctcgtcggctccgaagtcgtcgctacgtcncgcccaccgtggcactcaccgcgcctcgagacgtcggggacgacggaccgtagttacgtttcgcggcgacgaaacngtgggacttccgacgtccgttaggtaccttgggtcggggttcgttccggggacgttacgggttcggggaacccttaagggttccgttaccgggtaacccggttaccgtaacgggtaccgacgggttaccccgtaacgggttcccgttcccccggg

SEQ ID NO: 339488 - DNA, 527 bp, Homo sapiens
  misc_feature: GZ8MTXP01C78EH.17.10.A10.1.454.CMB.2.raw
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (470)..(470): a, c, t, g, unknown or other
  misc_feature (470)..(470): n is a, c, g, or t
  modified_base (511)..(511): a, c, t, g, unknown or other
  misc_feature (511)..(511): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccaatgttggattcaattatgtgtcctggtaccagcaactcccggatcacgcccccaaactccncatatatgaagataataagcacctnacggggttcccctgacgnttctctggctccaagtctggcacgtctgcccaccctggcatcaccgcgctccagacgtgggacgnggccgagtatttcgngcgcaacagtcgggattcccgagtccctagtctttcgtgggggtnttcgggcaggtcgggacaagcttgaaccctcgtaaggtccngccctaaggcctcccg

SEQ ID NO: 339489 - DNA, 531 bp, Homo sapiens
  misc_feature: GZ8MTXP01AMSB7.17.10.A10.1.454.CMB.2.raw
  modified_base (370)..(370): a, c, t, g, unknown or other
  misc_feature (370)..(370): n is a, c, g, or t
  modified_base (495)..(495): a, c, t, g, unknown or other
  misc_feature (495)..(495): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggactgaggtgcagaagcctggggcatcagtgactgtctcctgcaaggccagtggatatatcttcacaaaatatggtatgaattgggtgcgacaggcccccggacgaagggcgttgagtggggtgggggtgggtcgagcggctttggacggtaaggcacagtatgccaccgaagatgaagggcagngtcacgattaccacggacacccccacgaacacagtctacatgacactgacgagcctgagagcgtagacggacaccggccgtctattactgtgcgagtaattgtttctgttcattcgtataattgnttaggctcgtaagttggacttggtcttcgtcggggg

SEQ ID NO: 339490 - DNA, 615 bp, Homo sapiens
  misc_feature: GZ8MTXP01B5K2J.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacacggcccccggagaagggcttggaggtggggtgggggtgggtcgaggcggtcgtttggacggtaaggcacgagtatcgaccaccggaagagtacggaaggggacaggaacgtacaacgacttacccgaaccgggacccaaccccccgaacgaaccacaacgtactacatcgacaacgtgacgagcctaggagacgcgtacgaaccggaccgaccggtccgtactagttaccgtggtcgcgtaagtaatttcggttttctgttctattccggtaaactaagtttgagttacgggtctcgttaagtcggacgttcggtaaccgttttcggtaaccggggg

SEQ ID NO: 339491 - DNA, 532 bp, Homo sapiens
  misc_feature: GZ8MTXP01EDRHT.17.10.A10.1.454.CMB.2.raw
  modified_base (367)..(367): a, c, t, g, unknown or other
  misc_feature (367)..(367): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaaatatggtatgaattgggtgcgacaggccccccggaacaaggctgagtgggtgggggtgggtcagcggtcgtttgacggtaaggcacagtatgccaccgaagagtgaagggcagngtcacgataccacggaccaccccacgaacacagtcacatnacacagacgagcgngagagcgtgacgacgacgccgtcgtacttactagtgtgagaatgtttntttgttntattacgtactaatttagttgttagtgtctaatgtacgttcgtaacgttcgtcggg

SEQ ID NO: 339492 - DNA, 527 bp, Homo sapiens
  misc_feature: GZ8MTXP01ELTEQ.17.10.A10.1.454.CMB.2.raw
  modified_base (286)..(286): a, c, t, g, unknown or other
  misc_feature (286)..(286): n is a, c, g, or t
  modified_base (362)..(362): a, c, t, g, unknown or other
  misc_feature (362)..(362): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaatgggtgcgacaggcccccgganaagggcttgaggtgggtgggggtgggtcagcggctttgacggtaaggcacagtatgccacgaagatggaaggcagngtcacgataccaacggacacccccagaacacagtcacatgacaaactgacgagcctgagagctgacgacacgggcctctattacngtgcgagtaattggttttctgttcagttcgtaactaatttgattaggcttntaagtcggattcggtaactttcgcggggg

SEQ ID NO: 339493 - DNA, 289 bp, Homo sapiens
  misc_feature: GZ8MTXP01E0AGH.17.10.A10.1.454.CMB.2.raw
  modified_base (287)..(289): a, c, t, g, unknown or other
  misc_feature (287)..(289): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctggtcactctgttcccaccctcctcctagtctacgctgagcgggctggcaaggcgcatagnnn

SEQ ID NO: 339494 - DNA, 530 bp, Homo sapiens
  misc_feature: GZ8MTXP01A7MIZ.17.10.A10.1.454.CMB.2.raw
  modified_base (369)..(369): a, c, t, g, unknown or other
  misc_feature (369)..(369): n is a, c, g, or t
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggtggggtgggggtgggtcaggcggctttggacggtaaggcacagtatgccaccgaagatgaagggcagngtcacgattaccacggacacccccacgaacacagtctacatgacaactgacgagcctgagagctgacgacacggccgtctatacgtgtgtcgagtattggttttctgttcattcgtactaatttgattaggtctntaagtggacttggtaacttgtcgggg

SEQ ID NO: 339495 - DNA, 567 bp, Homo sapiens
  misc_feature: GZ8MTXP01DCU6H.17.10.A10.1.454.CMB.2.raw
  modified_base (289)..(289): a, c, t, g, unknown or other
  misc_feature (289)..(289): n is a, c, g, or t
  modified_base (524)..(524): a, c, t, g, unknown or other
  misc_feature (524)..(524): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccgganaagggcttggaggtggggtgggggtgggtcgaggcggctttggacggtaaggcacagtatgaccaccgaagagtagaagggcaggaagtcaacgattacccgacggaaccacccccgacgaaacacagtactaacatagacaactgaaccgagcctgagacgcgtacgacgaacgaccggccgtctattacgtgtgacgtagtaattgttttctgttctattcgtaatatttagnttacggtctagtaagtggacttggtaacgttcggtaacggggg

SEQ ID NO: 339496 - DNA, 532 bp, Homo sapiens
  misc_feature: GZ8MTXP01ERLJE.17.10.A10.1.454.CMB.2.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (497)..(497): a, c, t, g, unknown or other
  misc_feature (497)..(497): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccganaagggcttgagtgggtggggtggtcagcggtctttgacggtaggcacagtatgccaccgaagagtgaagggcagngtcacgataccacggacaccccacgacacagtctacatgcaactgacgagcctgagagcgtgacgacacggccgtctattactgtgcgtagaattgtttctgttctattcgttaactaatttgattagggtcctnttaagtgggtacttcgggtaactttcggtcggggg

SEQ ID NO: 339497 - DNA, 607 bp, Homo sapiens
  misc_feature: GZ8MTXP01BI6DL.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttacacaaatatggtatgaagttgggtgcgacacgggcccccggagaagggcttggaggtggggtgggggtgggtcaggcggtcgtttggacggtaaggcacgagtatgaccaccggaagagtaggaagggcagaagtcaacggtaacttacccgaccgggaaccaaccccccgaacgaaaccacacgtactaacatgaccaaactgaaccgagcctaggaagacgcgtaggaaccgaccgaccgggtccgtactacttacgtgtcgacgtaggtaattgttttctgttctattcgtaactaatttgttattacggtcttcgtaagtgggacttcgggtaacgtttcgggtaaccggggg

SEQ ID NO: 339498 - DNA, 548 bp, Homo sapiens
  misc_feature: GZ8MTXP01A8JB3.17.10.A10.1.454.CMB.2.raw
  modified_base (375)..(375): a, c, t, g, unknown or other
  misc_feature (375)..(375): n is a, c, g, or t
  modified_base (436)..(436): a, c, t, g, unknown or other
  misc_feature (436)..(436): n is a, c, g, or t
  modified_base (489)..(489): a, c, t, g, unknown or other
  misc_feature (489)..(489): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggtggggtgggggtggggtcgaggcggtcgttttggacgggtaaggcacagtatgccaccgaagatgaagggcagngtcagatacccacggacacccccagaacacagtctacatgacaactgacgagcctgaagancgtagacgacacgggcctctattactgtgacgataattgtttaactgttactnttaccgtataagtttgattacgggctgttaatggtacttggtaaccgtttgaacggggg

SEQ ID NO: 339499 - DNA, 564 bp, Homo sapiens
  misc_feature: GZ8MTXP01CS1YW.17.10.A10.1.454.CMB.2.raw
  modified_base (286)..(286): a, c, t, g, unknown or other
  misc_feature (286)..(286): n is a, c, g, or t
  modified_base (498)..(498): a, c, t, g, unknown or other
  misc_feature (498)..(498): n is a, c, g, or t
  modified_base (537)..(537): a, c, t, g, unknown or other
  misc_feature (537)..(537): n is a, c, g, or t
tcagcgtagactagcacgaccggtgctcgatttagcgtcgatctcaggggacccaaaaccacactcctccttgggagaatccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacgaggcccccgganaagggcttggaggtgggggtgggggtgggtcgaggcgggtcgttttggacgggttaaggcacagtatcgcacgaagagtgaaagggcaagagtcacgataccacggacaccccagaacacacgtctacatgacaactgaacgagcctagagaggctggaaccgaccgaccggtccgtctacgttaacgtgtcgacgtagtaacttgttttcnggtcttagttaccgtaattagtttgagttaaggtacctnttagtcggttacgtggaacgtttcggg

SEQ ID NO: 339500 - DNA, 553 bp, Homo sapiens
  misc_feature: GZ8MTXP01DDTL0.17.10.A10.1.454.CMB.2.raw
  modified_base (370)..(370): a, c, t, g, unknown or other
  misc_feature (370)..(370): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggagtgggtggggtgggtcaggcggcgtttgacggtaaggcacgagtatgaccaccgaagagtgaaggggcagngtcaacgataccacggacacccccagaacanagctanatgacaactgacgagctagagagcgtgaacgacaccggcgtctagttactgtgcgtaggtaattggttttaacnggttctattcgttactaattttgaattaggtctnttaagtagggtacttgggtaaccgttcggtaacggggg

SEQ ID NO: 339501 - DNA, 530 bp, Homo sapiens
  misc_feature: GZ8MTXP01EIZYS.17.10.A10.1.454.CMB.2.raw
  modified_base (373)..(373): a, c, t, g, unknown or other
  misc_feature (373)..(373): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccggagaagggcttggaggtggggtgggggtgggtcaggcggctttggacggtaaggcacagtatgccaccggaagagtgaaggggcagngtcacgattaccacgggacacccccagaacacagtactacatgacaactgacgagccctgagagcgtgacgacacgggcgtctattactgtgcgagtaatgtttaactgttcgtattcgtanaatttgnttaggctntaatgcttgtcgttgcgggg

SEQ ID NO: 339502 - DNA, 529 bp, Homo sapiens
  misc_feature: GZ8MTXP01CZ6V4.17.10.A10.1.454.CMB.2.raw
  modified_base (366)..(366): a, c, t, g, unknown or other
  misc_feature (366)..(366): n is a, c, g, or t
  modified_base (460)..(460): a, c, t, g, unknown or other
  misc_feature (460)..(460): n is a, c, g, or t
  modified_base (493)..(493): a, c, t, g, unknown or other
  misc_feature (493)..(493): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggcagtgatatatcttacacaaaatatggtatgaattgggtgcgacaggcccccggacaagggcttgagtggggtgggggtgggtcaggcggtctttggacggtaaggcacagtatgccacgaagatgaagggcagngtcaacgattaccacggacacccccacgaacacagtctacatgacaactgacgagcctgagagctagacgacacggcgtctattactgtgcganaattgtttctgttctattcgttaacaattttgnttaggctctaatggacttggtaacttgtaacggggg

SEQ ID NO: 339503 - DNA, 641 bp, Homo sapiens
  misc_feature: GZ8MTXP01BU6T4.17.10.A10.1.454.CMB.2.raw
  modified_base (250)..(250): a, c, t, g, unknown or other
  misc_feature (250)..(250): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaaggcagtgatatatcttanacaaatatggtatgaattgggtgcgacacggcccccggagaagggctggaggtggggtgggggtggtcaggcggtcgtttggacggttaaggcaacgtagtatgacccaccggaaagagtaggaaagggcaaggaacggtacaaacgggtaacttaacccgacgggaacccaaccccccgaagaaacctacacggtactacatacgacaaacgtgacgagcctagacgacgcgtagaccgacgaccggccgtacctattacgtgtcgacggtagtaattggttttaactcgttcctaagttacggttaaacctaagtttttggaagttacgggtcccttacgttaacgttgggtaacccgttgggtaaccgttttccggggtaaccggggg

SEQ ID NO: 339504 - DNA, 531 bp, Homo sapiens
  misc_feature: GZ8MTXP01BM8QY.17.10.A10.1.454.CMB.2.raw
  modified_base (288)..(288): a, c, t, g, unknown or other
  misc_feature (288)..(288): n is a, c, g, or t
  modified_base (364)..(364): a, c, t, g, unknown or other
  misc_feature (364)..(364): n is a, c, g, or t
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtgggtggggtgggtcagcggctttgacggtaaggcacagtatgccaccgaagatgaagggcagngtcacgattaccacggacaccccagaacacagtctacatgacaaacctgaacgagcctgagagctgacgacacggccgtctattactgtcgcgagtaattggtttaactggttcattcgtaactaatttgattacggctntaatggacttggtaactttggtcgggg

SEQ ID NO: 339505 - DNA, 573 bp, Homo sapiens
  misc_feature: GZ8MTXP01BEU39.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttcacaaaatatggtatgaattgggtgcgacacggcccccggacgaagggcttggaggtggggtgggggtggggtcgaggcgggtcgtttgggacggtaaggcacgagtatgaccaccggaagagtaggaagggcagaagtcacgacttaccgacggaccacccccacgaacacagtactacatgacaactgacgagcctagagagcgtagaccgacgaccggccgtctaacgtttacctggtgaccgtagtaattgttttctgttctattcgtaactaagtttgattaggtcttctaagtggacttcggtaacgttcggtaacggggg

SEQ ID NO: 339506 - DNA, 586 bp, Homo sapiens
  misc_feature: GZ8MTXP01DZYWL.17.10.A10.1.454.CMB.2.raw
tcagcgtagactagcacgaccggtgctcgatttagcgtcgatctcaggggagctctgcttcagttgtgagcgcagaaggcaggactcgggacaatcttcatcatgacctgctcccctctcctcctcacccttctcattcactgcacagggtcctgggcccagtctgtgttgacacagccgccctcagtgtctgcggccccggacaggaggtcaccatctcttgctctcgaaccccccaatgttgattcaattatgtgctggtaccagcaactcccggatcacgacccccaaactcctcatatatgaagataaataagcgaccctcgaggggttcctgaccgattctctgctcaagtctgcacgtctcgccacctggcatcacgcgctaccagacgtggggacgacggccgagttactttcgtcgcgacaaacgactggggacttcccgagccctggtacctttcggtgggggttcggtttcggcgtaacgggttcgggaaaccgaacggttccgttcggttaaccccggttccgtaacggggttccaaccgggccccgaaacggggtcccttccggtccccccccg

SEQ ID NO: 339507 - DNA, 556 bp, Homo sapiens
  misc_feature: GZ8MTXP01C5MGM.17.10.A10.1.454.CMB.2.raw
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
  modified_base (524)..(524): a, c, t, g, unknown or other
  misc_feature (524)..(524): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacacaaatatggtatgaattgggtgcgacaggcccccggacaagggcttgaggtggggtgggggtgggtcgaggcgggcgttttggacgggtaaggcacgagtatgccaaccggaagagtggaagggcaagngtacaacgattaccgacgggaccacccccaacgaacacagtactacatgacaactgacgagccagagagcgtagacgacacggccgtctataccgtgtgcgagtaatgtttctgttcctnttcgtataatttgagttaggctntaagtggacttggtaacttcggtaaccggggg

SEQ ID NO: 339508 - DNA, 569 bp, Homo sapiens
  misc_feature: GZ8MTXP01B0G7P.17.10.A10.1.454.CMB.2.raw
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
  modified_base (505)..(505): a, c, t, g, unknown or other
  misc_feature (505)..(505): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacagggccccccggagaagggcttggaggtggggtgggggtgggtcgaggcgggtcgttttgggcggtaaaggcacagtatggccaccggaagagtgaaggggcaagngtcaaggattacccgacggacacccccagaacacagtctanatgacaactgacgagcctgagacgcgtacgacggaccaccgggccttacctagttaactgtgcgtaagtaattgttttcgtnttctattacgtaactaatttgattacggtctgtaagtcggtacgttcggtaacgttcggcgggg

SEQ ID NO: 339509 - DNA, 522 bp, Homo sapiens
  misc_feature: GZ8MTXP01AUWPP.17.10.A10.1.454.CMB.2.raw
  modified_base (254)..(254): a, c, t, g, unknown or other
  misc_feature (254)..(254): n is a, c, g, or t
  modified_base (331)..(331): a, c, t, g, unknown or other
  misc_feature (331)..(331): n is a, c, g, or t
  modified_base (419)..(419): a, c, t, g, unknown or other
  misc_feature (419)..(419): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaacccccatgtgattcaatatgngtctggtaccagcaactccggatcagccccaaactcctcatatatgaagataataagcgacctcacggggttccccngacgattctctggctcaagtctggcacgtctcgcccaccctgggcatccaccgcgcctccagacgtggggacgaggccgagtatttcngcgacaacagtgggattccagtcctgaccgttgtggggtgttcgggcaggtcgggaccaagcttcggaaccgtcgtaaggtccaggccctaaggcctccccgg

SEQ ID NO: 339510 - DNA, 609 bp, Homo sapiens
  misc_feature: GZ8MTXP01BLGIR.17.10.A10.1.454.CMB.2.raw
  modified_base (524)..(524): a, c, t, g, unknown or other
  misc_feature (524)..(524): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccggagaagggcttggaggtggggtgggggtgggtcgaggcggtcgttttggacggtaaggcaacgagtagtgacccgaaccgaagagtaggaaaggggacaaggaagtaccaacgggtaacttaaccccgaaccgggaacccaaccccccgaaagaaacccacgaacgtactaaccatacgaccaaacgtcgaacgacgcctagagaagcgtaggacgaccgacgggcctctagttacngtgacgtagtaattgtttctgttctattcgtaactaagtttgattaggcttgtaagttgggacttggtaacgtttcggtcggggg

SEQ ID NO: 339511 - DNA, 654 bp, Homo sapiens
  misc_feature: GZ8MTXP01DBRKC.17.10.A10.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (468)..(468): a, c, t, g, unknown or other
  misc_feature (468)..(468): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaanaaatntaggtatgaagttgggngcgacgacgggcccccgagaagggcttggaggtggggtgggggtggtcgaggcggtcgtttagggaacggtaaggcacgtagtatcgaccaaccggaagagtaggaaaggggcaaggtaacgtacaaacgaacttaaccccgaaccggacccaaccccccgaaacgaaactacagtactacattcgacaacgngaaccgatcccgagagacgtcgagaaccgaccgtacgggcccgttatacgttaacgtggtccgacgtagtaagttcgttttaacgtggttctaaacgttccggtaaagttaaatttgggattaacgggtccttaacgttaacgtttacgggagttacggggtaaccgtttcgggtaacccgggggg

SEQ ID NO: 339512 - DNA, 598 bp, Homo sapiens
  misc_feature: GZ8MTXP01C2O85.17.10.A10.1.454.CMB.2.raw
  modified_base (287)..(287): a, c, t, g, unknown or other
  misc_feature (287)..(287): n is a, c, g, or t
  modified_base (557)..(557): a, c, t, g, unknown or other
  misc_feature (557)..(557): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccgganaagggcttgaggtggggtgggggtggggtcgaggcgggtcgttttaggacggtaaggcaacagtatgacccaaccggaaagagtaggaagggacaaggaagtcaacggaacttaccgaaccgggaccaaccccccacgaaaccacaacggtactaaccatacgacaacgtagacgagcctgagagcgtagaaccggacaaccggtccgtctattactggtgcgtagtaattgttttaactgttctattcgttaactatttgattacggtntacttaagtggacgttacggtaacgtttcggtaaccggggg

SEQ ID NO: 339513 - DNA, 538 bp, Homo sapiens
  misc_feature: GZ8MTXP01BY094.17.10.A10.1.454.CMB.2.raw
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaaccccccaatgttggattcaattatgtgtcctggtaccagcaaactcccgggatcacgcccccaaactcctcatatatgaagataataagcgaccctcgaggggttcccctgacgattctctggctccaagtctggcacgtctgccaccctgggcatccaccgcgctccagacctggggacaggccgagtactttctgcgcaaacngtgggattccagtccctagccttcgngggggttgttacgggcaggtcggggaaccaacgcttgaacccgtcctaagggtcacggccccaagggctcccgg

SEQ ID NO: 339514 - DNA, 605 bp, Homo sapiens
  misc_feature: GZ8MTXP01DNMYJ.17.10.A10.1.454.CMB.2.raw
  modified_base (465)..(465): a, c, t, g, unknown or other
  misc_feature (465)..(465): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaatatggtatgaattgggtgcgacgacggcccccggagaagggctttggaggtgggggtgggggtggggtcaggcgggtcgttttgggaacgggtaaggcacgaggtatggacccaaccggaagagtaggaaaggggacaagaaggtacaacgtaacttacccaacgggaacccaacccccgaacgaaacacacgtctaacatgactaacngacgagccagagacgcgtgaacgacgaccgggcctactatacgtgtgcggataattggttttctgttactattacgttaataagttttagagttacggtctagttaagtcggacgttggtaacgttttcggaaccggggg

SEQ ID NO: 339515 - DNA, 574 bp, Homo sapiens
  misc_feature: GZ8MTXP01B6DHC.17.10.A10.1.454.CMB.2.raw
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
  modified_base (372)..(372): a, c, t, g, unknown or other
  misc_feature (372)..(372): n is a, c, g, or t
  modified_base (501)..(501): a, c, t, g, unknown or other
  misc_feature (501)..(501): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaagccagtgatatatcttacacaaatntggtatgaattgggtgcgacagggcccccganaagggcttggaggtgggtggggtgggtcaggcggtctttggacggtaaggcacaggtatgccacggaagagtaggaagggacaagngtacaacgaacttacccgaccggaccacccccaacgaacacagtactaacgatgacaactgacgacgcctagagacgcgtagaccgacgacggtccgtctaacttgtggtagcgtaagtattgttttcngttactacgttcgtaactaatttagagttacggtcttacgtgtcggacttaggtaaccgttcggtaaccgggg

SEQ ID NO: 339516 - DNA, 632 bp, Homo sapiens
  misc_feature: GZ8MTXP01BL57W.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacacaaatatggtatgaattgggtgcgacacggcccccggacgaagggcttggaggtggggtgggggtggggtcgaggcgggtctttgggacgggttaaggcacgaggtatcggaccaccggagagtggaagggcaaggcgtacgaacgtacgttaacccgaccgggaccaacccccgaacgaaaccacagtctacatgacaacctgacgagcctagacgacgcgtacgacgaccgacggtccgtactacgtttacgtgtcgtacgtaagtaacgtttcgttttaacgtggttactaacgttaccgttaacgttaagttttcggattacggggtctttacgtaacgttggggtaccttaggggtaaccgttttcgggtccgggggg

SEQ ID NO: 339517 - DNA, 662 bp, Homo sapiens
  misc_feature: GZ8MTXP01EP9DJ.17.10.A10.1.454.CMB.2.raw
  modified_base (251)..(251): a, c, t, g, unknown or other
  misc_feature (251)..(251): n is a, c, g, or t
  modified_base (400)..(400): a, c, t, g, unknown or other
  misc_feature (400)..(400): n is a, c, g, or t
  modified_base (538)..(538): a, c, t, g, unknown or other
  misc_feature (538)..(538): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggcagtgatatatcttacaanaaatatggtatgaagttgggtgcgacgacggcccccggagaagggcttaggaggttggggtgggggtggtcgaggtcggtcgtttaggaacgggttaaggctaacgaggtaagtcgacccgaaccggaaagagtaggaagggacaaggngtacgaaacgtaacttaccccgaacggaccccaacccccgaacgaaaccacaacgtacctaacatacgaactaacgtagaccgaacgccgtagaagacgacgtaggaccgaaccgaccggtccgtacttacgttacgnggtgacgtaagtacgtttggtttctacggttctaacgttccgtaaacgttaagtttagttagttaacggttccttacgttaagtcgggtacgttacggttaaccggtttcgggtaacccggggg

SEQ ID NO: 339518 - DNA, 527 bp, Homo sapiens
  misc_feature: GZ8MTXP01CPRSD.17.10.A10.1.454.CMB.2.raw
  modified_base (365)..(365): a, c, t, g, unknown or other
  misc_feature (365)..(365): n is a, c, g, or t
  modified_base (459)..(459): a, c, t, g, unknown or other
  misc_feature (459)..(459): n is a, c, g, or t
  modified_base (502)..(502): a, c, t, g, unknown or other
  misc_feature (502)..(502): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccggacaagggcttgagtgggtgggggtgggtcagcggctttggacggtaaggcacagtatgccaccgaagagtgaagggcagngtcacgattaccacggacaacccccacgaacacagtctacatcgacaaacctgaacgagccctgagagcgtgacgacacgggccgtctattacngtgcgtagaattgtttctgttcattcgtaatatttgattaggntctgtgattggtaacttcggtgggg

SEQ ID NO: 339519 - DNA, 615 bp, Homo sapiens
  misc_feature: GZ8MTXP01EP6HG.17.10.A10.1.454.CMB.2.raw
  modified_base (379)..(379): a, c, t, g, unknown or other
  misc_feature (379)..(379): n is a, c, g, or t
  modified_base (424)..(424): a, c, t, g, unknown or other
  misc_feature (424)..(424): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaatatggtatgaattgggtgcgacgacgggcccccggagaagggcttgagggtggggtgggggtggtcgaggcggtcgtttggaacggtaggcacgagtatgaccacggaagagtggaagggcagngtcaacgtatacccgacggacccacccccgagaacacagctacgntacgacaactgaccgagcccagacgacgcgtacggaaccgaccgaccgggtccttactaacgtttacgtggtcggtacggtagtaacgtttgttttccgtagttcgtaactttccggtaaattaagtttggttagttacggtcttacgtaagttgggtaacgttgggtaaccgttttcgggaaccgggggg

SEQ ID NO: 339520 - DNA, 520 bp, Homo sapiens
  misc_feature: GZ8MTXP01ANCDB.17.10.A10.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
  modified_base (496)..(496): a, c, t, g, unknown or other
  misc_feature (496)..(496): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggcccccgganaagggcttgagtgggtggggtggtcagcggctttgacggtaaggcacagtatgccaccgaagatgaaggcagaagtcacgattaccacggacacccccagaacacagtctacatgacaactgacgagcctagagagcgtgacgacacggccgtctattacngtgcgagtaattgtttcngttcattcgtacaatttgattaggctttntaagtgacgttgtcgttcggtggg

SEQ ID NO: 339521 - DNA, 586 bp, Homo sapiens
  misc_feature: GZ8MTXP01DEETJ.17.10.A10.1.454.CMB.2.raw
  modified_base (381)..(381): a, c, t, g, unknown or other
  misc_feature (381)..(381): n is a, c, g, or t
  modified_base (451)..(451): a, c, t, g, unknown or other
  misc_feature (451)..(451): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaatatggtatgaattgggtgcgacacggcccccggagaagggcttggaggtggggtgggggtgggtcaggcggtctttggaacggtaaggcacgagtatgacccacggaagagtggaaaggcaagngtacaacgtattacccgacggaacccacccccaacgaactacagtactacagtgacaactcgacgagccngagacgcgtacgaacgaccgaccggccgtctagttactagtcgacgagtaattcggttttctgttctattaccgttaataagtttgagttacggtcttactaagttggacgttggtaacgttcggtaaccggggg

SEQ ID NO: 339522 - DNA, 693 bp, Homo sapiens
  misc_feature: GZ8MTXP01AIE07.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatgtatcttacacaaaatatggtatgaattgggtgcgacacggcccccggacaagggcttggaggtggggtgggggtgggtcaggcgggtctttggacggtaaggcacgagtagtgccaaccggaagagtaggaagggcaaggcgtcaacgattacccgaacgggaccaacccccgaacgaaacctacacgtacctaacatcgacaactgacgagaccctaggagacgcggtacggaaccggaccgaacccgggtcccgttacgtaagtttaccgtagggttacggaccggtaaaggtaaacgttttcggtttttaacgtacgggtttacctaaacgtttcccgggttaaaccttaaagtttttcggaaagtttaacgggggtccctttacggttaaagttcgggggtaaccgtttcgggggttaacccgttttccgggggtaacccgggggggg

SEQ ID NO: 339523 - DNA, 560 bp, Homo sapiens
  misc_feature: GZ8MTXP01ER63W.17.10.A10.1.454.CMB.2.raw
  modified_base (250)..(250): a, c, t, g, unknown or other
  misc_feature (250)..(250): n is a, c, g, or t
  modified_base (380)..(380): a, c, t, g, unknown or other
  misc_feature (380)..(380): n is a, c, g, or t
  modified_base (521)..(521): a, c, t, g, unknown or other
  misc_feature (521)..(521): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttanacaaaatatggtatgaattgggtgcgacacggcccccggagaagggcttggaggtggggtgggggtgggtcgaggcggctttggacggtaaggcacagtatgaccaccggaagagtaggaaggggacagngtacaacgattaccgacggaccacccccaacgaacacagtctacatgacaactgacgagtccagagagactagacgacgaccggccgtctattactggtgccgagtaattgttttaactgttctattacgtaataatttgnttaggtctctaagtggacttggtaacgttggtaacgggg

SEQ ID NO: 339524 - DNA, 594 bp, Homo sapiens
  misc_feature: GZ8MTXP01D9G9U.17.10.A10.1.454.CMB.2.raw
  modified_base (402)..(402): a, c, t, g, unknown or other
  misc_feature (402)..(402): n is a, c, g, or t
  modified_base (448)..(448): a, c, t, g, unknown or other
  misc_feature (448)..(448): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttacaacaaaatatggtaatgaagttgggtgcgacgacgggcccccggagaagggcttggaggtggggtgggggtgggtcgaggtcgggtcgttttagggacgggttaagggcaacgaggtaatggacccaaccggaaagagtaggaaggcaagngtacaacgtattacccgacggaaccacccccagaaccacagtacanatgacaactgacgagccagagagcgtaggacacgacggcctacgttattacgtagtgacgtagtatttggtttaactgttcacgttcgtaattaagtttgaagttggtctacgtaagtcggtattcggtaacgtttcggaacgggg

SEQ ID NO: 339525 - DNA, 657 bp, Homo sapiens
  misc_feature: GZ8MTXP01BAP4H.17.10.A10.1.454.CMB.2.raw
  modified_base (384)..(384): a, c, t, g, unknown or other
  misc_feature (384)..(384): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtgatatatcttacacaaatatggtatgaagttgggtgcgacgacggcccccggagaagggcttggaggtggggtgggggtgggtcgaggcgggtcgtttggacggtaaggcacgagtatgccgaccgaagagtaggaagggacaaggngtacaacgtacttaccgacggaccacccccaacgaacacagtactacatgacaactcgacgacgccgtagagacgacggtacggacggaaccgaccgggaccgttaccgttaacgttaccgtaggttcggaccgtaagttaaaccgtttgggtttttcttcggttacctaagttacccggttaaacttaaacgttttagggaatttaacggggtcccttacgttaaggttacgggtacgttacgggttaaccgtttcgggtaacccggggggg

SEQ ID NO: 339526 - DNA, 653 bp, Homo sapiens
  misc_feature: GZ8MTXP01D38V2.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtgatatatcttacaactaaatataggtatagaagttgggtgcgacgacgggcccccggagaagggcttggagggtggggtgggggtgggtcgaggtcggtcgtttaggacgggttaaggcaacgaggtatcggaccgaaccggaaagagtagggaagggacgaagaaggtaccaaacggtaacttaaccccgaaccgggacccaaaccccccgaacgaaaccacacgtacacatagactaactgacgacgccgtagacgacgcgtacggaccgaaccgaccgggcccgtacgttacgttacgtaggtcgtacggtagttaagtttcggttttctgttacctattcgttaattaagtttagttagttacggtcttctaaggttcggtacgttcgggtaacgtttcgggtaaccggggg

SEQ ID NO: 339527 - DNA, 598 bp, Homo sapiens
  misc_feature: GZ8MTXP01A6CXU.17.10.A10.1.454.CMB.2.raw
  modified_base (421)..(421): a, c, t, g, unknown or other
  misc_feature (421)..(421): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtggatatatcttacacaaatatggtatgaattgggtgcgacgacggcccccggacgaagggcttggaggtggggtgggggtgggtcgaggcggtctttggacggtaggcacgagtatgaccaccgtaagagtaggaagggacagcgtacacgattacccacggaccaccccacgaacacagtctantgacaactgacgagcctagagagcgtaggaacgaccgacggccgtacgttacgttaacgtcgtgaccggtaagtaacgtttggttttctggttctattaccggttaattaagtttagagttacgggtccttgtaacgttcgggtacgttcgggtaaccgtttcgggtaaccgggggg

SEQ ID NO: 339528 - DNA, 545 bp, Homo sapiens
  misc_feature: GZ8MTXP01E1QS0.17.10.A10.1.454.CMB.2.raw
  modified_base (251)..(251): a, c, t, g, unknown or other
  misc_feature (251)..(251): n is a, c, g, or t
  modified_base (257)..(260): a, c, t, g, unknown or other
  misc_feature (257)..(260): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (379)..(379): a, c, t, g, unknown or other
  misc_feature (379)..(379): n is a, c, g, or t
  modified_base (382)..(383): a, c, t, g, unknown or other
  misc_feature (382)..(383): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatctcacanatatgnnnntantcncgcgtcgcgtcgctacggggaccgttagggacggttgggtacggggtggggtcgggtaggtcgggacgtttggacggttaaggctcccggaggtcagtctacgaagactgacncanntctctctcactcacgcacgaccgcncncncncncncncncncncncnccncnccnccgccgcaccactacactacactaactacttactacgacgtacgtaccttacgttccgttacgtaacgtacgtaacgttacgtacgttacgtaacgttaacgtaacg

SEQ ID NO: 339529 - DNA, 533 bp, Homo sapiens
  misc_feature: GZ8MTXP01D8XNI.17.10.A10.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatatggtatgaattgggtgcgacaggcccccgganaagggcttggaggtgggtgggggtgggtcagcggtctttggacggtaaggcacagtatgccaccggaagatgaaggcagngtcacgattaccacggacaccccacgacacagtctacatgacaactgacgagcctgagagcgtagacgacacggccgtctattacgtagtgcgtagaattgtttctgttcattcgtaactaatttgattaggcttctaagtggacttggtaacttcggtcggggg

SEQ ID NO: 339530 - DNA, 561 bp, Homo sapiens
  misc_feature: GZ8MTXP01CHBAV.17.10.A10.1.454.CMB.2.raw
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctgcggcccccgganaggaggtcaccatctcttgctctcggaaaccccccaatgtggattcaattatgngtcctggtaccagcaaacgtcccggatcacgcccccaaaactcctacaatataataggaaataataaattaaagcgaaccctcgacggggtttaccccctgacgtattctctcggcttcccaaagtctaggccacgtctgcccacccgtggcaacncacgcnctacgagcgagggacgacggctagttacgttcncgacacaagtagtcgtacgtactcgtctcgtcgtcgtggtcggttcggtcgcggtacggtacgacgcgttcgtaacgtcgtaacgtcgacgaccgtaacgcgtccg

SEQ ID NO: 339531 - DNA, 687 bp, Homo sapiens
  misc_feature: GZ8MTXP01ARIFH.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaatatggtatgaagttgggtgcgacgacgggcccccggagaagggtcttggagggtggggtgggggtgggtcgaggcggtcgtttagggaacggtaaggcacgagtagtcgaccgaaccggaaagagtaggaaggggacaagggcgtacgaacggaacttaccccgaacgggaaccccacccccaacgaaacacacgtactacagtcgacaacgtgaacgacgcctaggaacgagacggtacgaaccggaaccgaccgggtacctcgttaacttacgtggttcgaccggtaaggttaacgtttggttttccgtaggttaccctaagttacccggtttaaacttaaggttttacggttaaggttacgggtcctttaccgttaaggttacggggtacgttacggggttaaccgtttcgggggttaacccgggggg

SEQ ID NO: 339532 - DNA, 554 bp, Homo sapiens
  misc_feature: GZ8MTXP01CJH44.17.10.A10.1.454.CMB.2.raw
  modified_base (253)..(253): a, c, t, g, unknown or other
  misc_feature (253)..(253): n is a, c, g, or t
  modified_base (446)..(446): a, c, t, g, unknown or other
  misc_feature (446)..(446): n is a, c, g, or t
  modified_base (525)..(525): a, c, t, g, unknown or other
  misc_feature (525)..(525): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagcctggggcatcagtgactgtctcctgcaaggccagtggatatatcttacaanaaatatggtatgaattgggtgcgacacggcccccggagaagggcttggaggtggggtgggggtggggtcgaggcggtcgtttggacggtaaggcacgagtatgacccacggaagagtagaaagggcagaagtcaagattacccaggaaccaccccaagaacacagtactacaatgacaactgacgagccaganagcgtagacgacgcggcgtactattactgtgtcgagtaattggtttaactgttacattcgtaataatttgattacggtntctgtgacgttggtaacttggtaacgggg

SEQ ID NO: 339533 - DNA, 700 bp, Homo sapiens
  misc_feature: GZ8MTXP01B24PR.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaagttgggtgcgacgacgggcccccggagaagggtcttggaggtggggtgggggtgggtcgaggtcgggtcgttttaggacgggttaaggcaacgtaggtagtgaccccgaaccggaagagtacggaaaggggccaaggaagttaccgaaacgtaacgtttaaccccgaaccgggaccccaaaccccccgaacgaaaccacgtacgtactacatagacctaaacgtgaacgacgccgtaggacgacgacggtacggaaccgaacgacccgggtaccgttaccgttaagtttaccgtaggtacgtacggtaagttaaacgtttcgtttttcctaggttacctaagttacgtttaaacctaagtttttggattaacgggtcttaccgttaaggttgggtaacgttcggggttaaccgttttcggtaacccgggggg

SEQ ID NO: 339534 - DNA, 655 bp, Homo sapiens
  misc_feature: GZ8MTXP01DU2J5.17.10.A10.1.454.CMB.2.raw
  modified_base (461)..(461): a, c, t, g, unknown or other
  misc_feature (461)..(461): n is a, c, g, or t
  modified_base (581)..(581): a, c, t, g, unknown or other
  misc_feature (581)..(581): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcgccggcccccggacgaggacggtccacctatctcttcgctcctaccggaaacccccctattgttgtattactaattatgtcgtccgtacgtaccagacctaaccgtcccggactccgaacccgaccccctaaactcctaccaattaatacgtaagaataactaaacgtaacgacccgtaacccgtcggtacggggtttccccctacggtaccgtattctcgtacggcctcgtaagtcgtacgctacgtctcgccctaccgtgactacnccgaccggctacccgtacgacggtaccggtacgggggacgacgggtccgtagtttacgttcgcggaccacaacgtagtcggtacttaccgcgtctagttccgtgggtaagggttcgcggnttacgggtcggaaccaggttcgttacgtaaccccgtgttaacggccacggacccgtaacggttcccgtccccgg

SEQ ID NO: 339535 - DNA, 585 bp, Homo sapiens
  misc_feature: GZ8MTXP01B47QV.17.10.A10.1.454.CMB.2.raw
  modified_base (467)..(467): a, c, t, g, unknown or other
  misc_feature (467)..(467): n is a, c, g, or t
  modified_base (522)..(522): a, c, t, g, unknown or other
  misc_feature (522)..(522): n is a, c, g, or t
  modified_base (544)..(544): a, c, t, g, unknown or other
  misc_feature (544)..(544): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaattgggtgcgacacggcccccggagaagggcttggaggtggggtgggggtgggtcgaggcggtctttggacggtaaggcacgagtatgacccaaccggaagagtaggaaggggcaagaaggtcaaacggtacttaacccgacgggaaccaccccccgaagaacacgaagttcaacatcgacaaactgacgagcctgagngcgtgaaccggacacgggtcctactacgttactggtgacgtagtaattggtttcngttctattcgtaactatttcgnttacggtcttagtaagtcggtacttggtctttcgggcgggg

SEQ ID NO: 339536 - DNA, 565 bp, Homo sapiens
  misc_feature: GZ8MTXP01DFNOJ.17.10.A10.1.454.CMB.2.raw
  modified_base (363)..(363): a, c, t, g, unknown or other
  misc_feature (363)..(363): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggacaagggcttgagtgggtggggtgggtcagcggctttgacggtaaggcacagtatgccaccgaagatgaaggcagngtcaacgattaccacggacacccccacgaacacagtctacatgacaaactgaacgagcctagagagcgtaggaaccgaaaacggccgtactaattacgtgtagcgtagtaattggttttctgttcattcgttaactaaagttttgagttaggcttctaagttgggtaacttgggttaactttcggttgggggtaaccccggg

SEQ ID NO: 339537 - DNA, 560 bp, Homo sapiens
  misc_feature: GZ8MTXP01BH8BS.17.10.A10.1.454.CMB.2.raw
  modified_base (379)..(379): a, c, t, g, unknown or other
  misc_feature (379)..(379): n is a, c, g, or t
  modified_base (503)..(503): a, c, t, g, unknown or other
  misc_feature (503)..(503): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaatatggtatgaattgggtgcgacacggcccccggacaagggcttggaggtggggtgggggtgggtcgaggcggtcgtttggacggtaaggcacgagtatggaccaccggaagagtaggaagggacagngtacaacgattacccgacggaccacccccacgaacacagtctacatgacaacgtgacgacgcctagagacgcgtagacgaccgacgggccgtactattacgtgtcgacgtagtaattggtttcngttctattccgtataatttgattaggctcgtgtggacttggtaacgttcggtcgggg

SEQ ID NO: 339538 - DNA, 631 bp, Homo sapiens
  misc_feature: GZ8MTXP01BM3P4.17.10.A10.1.454.CMB.2.raw
  modified_base (457)..(457): a, c, t, g, unknown or other
  misc_feature (457)..(457): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtggatatatcttacaactaaaatatggtaatgaaagttgggtgcgaacgacgggcccccggagaagggcttggaggtggggtgggggtgggtcgaggcgggtctttagggaacggtaaggcacgaggtagtgacccgaaccggaaagagtaggaagggcaagaagtcaaacgtacttacccgaacggacccaaccccaagaacacagtacacatgacaacngaacgagccgtgacgacgcgagaccgaacgacgggtcccgtatacgttagtagttcgagtagtaaagtttgtttaaccgtggttacctattaccggttaaacttaagttttagagttacgggtaaccttagtaacgtaacgggtagttcggtaacgttttcgggtaaccggggg

SEQ ID NO: 339539 - DNA, 565 bp, Homo sapiens
  misc_feature: GZ8MTXP01D5WC3.17.10.A10.1.454.CMB.2.raw
  modified_base (253)..(253): a, c, t, g, unknown or other
  misc_feature (253)..(253): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcagggacccaaaaccacaccctccttgggagaatccctagatcacagctcctcaccatggactggacctggagcattcctttttcctggtggcagcaggcacaggtgcccacgcccaggttcagttggtgcagacgtggggctggaggtgcaggaagccgtggggcatcagtgactgtctcctgcaaggccagtgatatatcttacaanaaatatggtatgaagttgggtgcgacgacgggcccccggagaagggcttggagggtggggtgggggtgggtcgaggccgggtntttgggaacggtaggcacgagtangcccacggaagtagnggaacgggcagtgcaacgataccgacggacacccccagaacactagtcacananacactagacgacgcgagagagacggacgacgacgacgtccgtacgtagttacgtagtgtgtagtagttgtttcttcgttntacgttacgtattattagttgttagtctgtaagtgtacgttagtcgttcggtcggg

SEQ ID NO: 339540 - DNA, 594 bp, Homo sapiens
  misc_feature: GZ8MTXP01ETHYF.17.10.A10.1.454.CMB.2.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaattgggtgcgacgacgggcccccggagaagggctggaggtggggtgggggtgggtcaggcggtgtttggaacggtaaggccagaggtatcgaccgaccggaagagtagaagggacagaagtcacgacttaccgacgggaccaccccgaacgaacacagtactacatgacaactgaacgagccctaggacgacgcggtacgaaccggacacgggtcccttacgtattacgtagtcggacgtagtaactttgttaactgttctattacgtaataagttagttattaggtcctgtaagtcgtacgttggtaacgttcggtaaccggggg

SEQ ID NO: 339541 - DNA, 722 bp, Homo sapiens
  misc_feature: GZ8MTXP01DEUXU.17.10.A10.1.454.CMB.2.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtgatatatcttanaacaaaatatggtatgaagttgggtgcgacacgggcccccggagaagggcgttggagggtggggtgggggtggggcaggtccggtacgttttggaacgggtaaggcacgagtatcgacccgaaccggaaagagtaggaaaggggacaaggaacggtaccaacggtaaacttaacccgaccgggaacccacccccgaaacgaacacagtactacatcgacaaactcgaacgagcccgtagacgaacgcgtacggaaccgaaccgtaccggggtaccgttactttaaacgttaccggttaggtcggtaaccggtaaggtttaaacgttttcgggtttttaactcgggttaacccttaagtttaccgttaaaaccgtttaagttttacggttaagtttaccggggttaactttaccggttaagtttacgggtaccgtttacggggttaaccgttttcgggggtaaaccccgggggg

SEQ ID NO: 339542 - DNA, 627 bp, Homo sapiens
  misc_feature: GZ8MTXP01BFXFO.17.10.A10.1.454.CMB.2.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (384)..(384): a, c, t, g, unknown or other
  misc_feature (384)..(384): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatntggtatgaattgggtgcgacgacgggcccccggagaagggcttggaggtggggtgggggtgggtcgaggcggtcgtttggacggtaaggcacgagtatcgaccgaccggaagagtaggaagggcaagngtcgaacgtaacttacccgaacgggacccaacccccgaacgaacacgacgtacctacagtcgaccaaacgttacgaacggacgacccgtaggaacggacgcggtacggaaccggaaccgaccgggtcccgttacgtacgtttaacgtcggtggtaccgtaagtaacgtttgttttctgttcctattcgtaactaagtttgattaggtcttcgtaagtggtacttcggtaacgttcggtcgggg

SEQ ID NO: 339543 - DNA, 555 bp, Homo sapiens
  misc_feature: GZ8MTXP01C8OWL.17.10.A10.1.454.CMB.2.raw
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (527)..(527): a, c, t, g, unknown or other
  misc_feature (527)..(527): n is a, c, g, or t
tcagcgtagactagcacgaccggtgctcgatttagcgtcgatctcaggggacccaaaaaccacactcctccttgggagaatcccctagatcacagctcctcaccatggactggacctggagcattccttttcctggtggcagcaggcacaggtgcccacgcccaggttcagttggtgcagactggggctgaggtgcagaagccgtgggcatcagtgactgtctctgcaagcagtgatatatctananaaatntgtangaattgggncgacacggccccganaaggcttggaggtggggtgggggtggtacaggtcggtctttaggaacggtaggcagagtatcgacacgaagataggaaagggcaagagtcgacgtaactacccgacggaccaaccccccaagaaacacagtaccaacatacgacaacagacgacgccgagagaggactagacgacgacggccgtactacttagtgtgagtagtaattaagtttcgttgtcttatacgtattaattgttagtaagtntctagtggttacgtggttaacgttcggg

SEQ ID NO: 339544 - DNA, 670 bp, Homo sapiens
  misc_feature: GZ8MTXP01A4CBZ.17.10.A10.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (287)..(287): a, c, t, g, unknown or other
  misc_feature (287)..(287): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctctgcaaggcagtgatatatcttnacaaatntggtatgaattgggtgcgacgacggcccccgganaagggctttggaggtggggtgggggtggtcgaggcggtcgtttggacggtaaggcacgagtagtcgaccacggaagagtaggaaagggcagaagtcaacggtacttaccgacggaccacccccgaagaaccactacgctacactagactaaacgtcggacgacgacccgtagaagacgtcgaacggacggaccgaaccggtccggttacctaaagttcccgtagggtaccgtacggtaaacggttaaatttcgggttttaaccctgggtttacctaaacgtttacccggttaaacgtaattttaggggaaccttttaggggaactttaccggtaagttcgggtaacgttcggggttaaccgttttccgggggtaaccgggggg

SEQ ID NO: 339545 - DNA, 654 bp, Homo sapiens
  misc_feature: GZ8MTXP01D09EV.17.10.A10.1.454.CMB.2.raw
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccgganaggagtcaccatctcttgctctacgaaccccccatgttgattcaattatgtntcctgtaccagcaactcccggatcacgcccccaaactcctacatatatgaagataataagccgacccgtcgacggggttccccctggacgtattcctcgtacggcctccgaagtctcggccaccgttctcgcccacccgttgggcctaacgtccaacccggcgtcccgtaccaggaccggtgggggaacccgacgggacccgtaggttaactttcgtacggccgaccaaaccgagttcggggactttacccgaggtcccttacggtacgtttccggtgggggtttcgttacggggtcttagggttacggggaacccttaacggttccgttaccgaacccggtttccgtaacgggggttcaacccggaccccgtaacggggttccccttcccccggg

SEQ ID NO: 339546 - DNA, 688 bp, Homo sapiens
  misc_feature: GZ8MTXP01AZZTE.17.10.A10.1.454.CMB.2.raw
  modified_base (383)..(383): a, c, t, g, unknown or other
  misc_feature (383)..(383): n is a, c, g, or t
tcagcgtagactagcacgaccggtgctcgatttagcgtcgatctcaggggacccaaaaaccacacccctccttgggagaatcccctagatcacagctacctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaattgggtgcgacgacggcccccggagaagggcttggaggtggggtggggtgggtcgaggcgggtcgtttggacggtaaggcacgagtatgaccaccgaagagtaggaagggcagngtacacgtacttacccgacggacccacccccgaacgaaccacaggtacctaacgatacggaccaaacgtacgacgacgccctgagagcggtacgaaccggaccgaccgggtacccgttactacgtttaacgtggtacgtacggtaagttaaaccgtttgggtttttcctacggtttactaaactttcccgggttaaacttaagttttttcgggaaagtttacggggtaaccctttaccgtttaaacggttggggtacccgtttacgggggtaacccgttttttccgggggtaacccggggggggg

SEQ ID NO: 339547 - DNA, 678 bp, Homo sapiens
  misc_feature: GZ8MTXP01BYZTN.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaatatggtatgaattgggtgcgacgacggcccccggagaagggcttggaggtggggtgggggtgggtcaggcggtcgtttaggacggtaaggcacgagtagtcgaccgaccggaagagtaggaagggcaaggaacgtcaacgtacttacccacgggaacccacccccaacgaaccacgagtcctacatcgactaacgtcgaacgagccgtaggaagacgacgtacggaaccggaccgaccgggtacccgttacgttaacgtttacgtacggttcgtaccgggtaaaggttaaatttgggttttaaccttcggttacttaacgttaccggttaaaccttaagtttttcggaaagtttacgggtaaccctttacgttaagttcggggtaccttacgggggtaaccgttttccggggtaacccgggggg

SEQ ID NO: 339548 - DNA, 527 bp, Homo sapiens
  misc_feature: GZ8MTXP01AJG7D.17.10.A10.1.454.CMB.2.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (437)..(437): a, c, t, g, unknown or other
  misc_feature (437)..(437): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagtacaggtgcccacgcccaggttcagttggtgcagactggggctgaggtgcagaagcctggggcatcagtgactgtctcctgcaaggccagtggatatatcttcacaaaatatggtatgaattgggtncgacaggcccccgganaagggcttgagtggggtggggtgggtcaggcggctttgacggtaaggcacagtatgcacgaagatgaaaagggcaagagtcacgattaccacggacacccccacgaacacagtctacatagcaaactgacgagccngagagggctgacgacacggccgtctattactgtgcgagaatgtttcttgtcatcgtattagtttnataaggntctatggactggcttcgg

SEQ ID NO: 339549 - DNA, 567 bp, Homo sapiens
  misc_feature: GZ8MTXP01EHFNM.17.10.A10.1.454.CMB.2.raw
  modified_base (498)..(498): a, c, t, g, unknown or other
  misc_feature (498)..(498): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaaatatggtatgaattgggtgcgacacggcccccggagaagggcttggaggtggggtgggggtgggtcgagtcgggtcgtttggaacggtaaggcacagtatgaccgaccggaagagtggaagggcagaacgtcacgatacccacggaccaccccgagacacagtactacatgacaactgacgagcctgagagcgtagacgtaacaccggtccgtctatttacgtgtagccgtagtaattgtttaacnggttacagttcgtataatttggattagggccttgtaagtcgggtacttgggtaaccgttcggtcggggg

SEQ ID NO: 339550 - DNA, 543 bp, Homo sapiens
  misc_feature: GZ8MTXP01BWDLV.17.10.A10.1.454.CMB.2.raw
  modified_base (289)..(289): a, c, t, g, unknown or other
  misc_feature (289)..(289): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaaggccagtggatatatcttcacaaaatatggtatgaattgggtgcgacacggcccccgganaagggcttgaggtggggtgggggtgggtcgagcggctttggacggtaaggcacagtatgccaccgaagatggaaggcagaagtcacgattaccacggacacccccagaacacagtactacatcgacaactgacgagcctagagagcgtgacgacacggccgtactattacgtgtgcgtaagtattggtttaactgttctattcgtaactatttgattaggtctcgtaagtggacttggtaacgttcggtcgggg

SEQ ID NO: 339551 - DNA, 676 bp, Homo sapiens
  misc_feature: GZ8MTXP01DBE68.17.10.A10.1.454.CMB.2.raw
  modified_base (368)..(368): a, c, t, g, unknown or other
  misc_feature (368)..(368): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatagaattgggtgcgacgacgggcccccggagaagggtcttggaggtggggtgggggtgggtcaggcggtcgttttagggaacgggtaaggcacgaaggttancgacccgaaccggaaagagtaggaaaggggcaaggaagtacaaacgaacttaacccgaaccggacccaacccccaacgaacacagtactanatgacaacgtgaccganccagaacgagacgtaggaaccgacgaaccggtccgttacttaagttaccgtaggtcgtacggtaagttaacgtttggtttttaacctgggttactaaacgtttaccggttaaacttaagttttcggttaagttacgggtctttaaccgttaagttcggggtaaccgttgggttaacccgttttcggggtaacccgggggg

SEQ ID NO: 339552 - DNA, 628 bp, Homo sapiens
  misc_feature: GZ8MTXP01BFOKG.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgttggattcaattatgtgtcctggtaccagcaacgtcccggatcacgcccccaaactcctacatatatagaaagataataacgccgaccctcgacggggttcccctacggaccgtattcctcgtcgggacctccgaagtcctgggctacgtctcgccctacccgtgggccactccgacccgcgaccttcccgaaggaccgtggggaacgacgggccgtaggttactttcgaggccgacaaaccgtgtcggggtactttacccgaggtccccttggtaaccgtttcgggtgggggttcgttccgggcgttaggttcggggaaccttaggccttacgggaaccccgttcctaacgggtccacggccccgtaaggttccctccccgg

SEQ ID NO: 339553 - DNA, 514 bp, Homo sapiens
  misc_feature: GZ8MTXP01A1BJ3.17.10.A10.1.454.CMB.2.raw
  modified_base (256)..(256): a, c, t, g, unknown or other
  misc_feature (256)..(256): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctctgctctcggaacccccaatgttggattcaatatgngtctggtaccagcaactcccggatcacgcccccaaactcctcatatactagaaagataaataagccgacctcgacggggttcccctgaccgtattctctggcctccaagtctggcacgtctcgcccacctggcacncncgcgcncacgcgnggacgcgcgtagtcgttctcgcgacacngtgtactcncgtcgtcgtcgtcgtggtcgttcgtcgngtacgacgacgcgcgtcgtcgtcgcgacgaccgtcgcgtccg

SEQ ID NO: 339554 - DNA, 620 bp, Homo sapiens
  misc_feature: GZ8MTXP01AF90D.17.10.A10.1.454.CMB.2.raw
  modified_base (419)..(420): a, c, t, g, unknown or other
  misc_feature (419)..(420): n is a, c, g, or t
  modified_base (444)..(444): a, c, t, g, unknown or other
  misc_feature (444)..(444): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacaacaaaatatggtatgaattgggtgcgacacggcccccgagaagggctgaggtggggtggggtggtgaggcggtcgtttggacggttaggcacgagtatgaccacgagagtaggaaggcaagcgtacacgattacccgacggacacccccaagacaacgagtctacgannacaactgacagccagacgagtcgnggacgacgaccgggtctacgtactacgtagtacgccggtagtaagtttcggtttccgtagttacccgtaattacccggttaaacgttaaaatttcggttaacgttaaggggtccctttacgttaacgttggggtaaccgttcggggttaaccgttttccggggtaacccggggggg

SEQ ID NO: 339555 - DNA, 569 bp, Homo sapiens
  misc_feature: GZ8MTXP01DWC89.17.10.A10.1.454.CMB.2.raw
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacagggcccccgganaagggcttggaggtggggtgggggtggggtcaggcggtcgtttggacggtaaggcacagtatgccaccgaagatagaaggcagngtcacgataccacggaccaccccacgaacacagtctacatgacaactgaacgagccgtgaacgacgcgtacggaacgaaccaccgggccgtccttattacgtgtcgngtaagtaattggttttctgttcctagttccgtaactaagttttgattagggtcctataagtggacttcggtaacgtttcggaaccggggg

SEQ ID NO: 339556 - DNA, 618 bp, Homo sapiens
  misc_feature: GZ8MTXP01AXYCI.17.10.A10.1.454.CMB.2.raw
  modified_base (258)..(258): a, c, t, g, unknown or other
  misc_feature (258)..(258): n is a, c, g, or t
  modified_base (382)..(382): a, c, t, g, unknown or other
  misc_feature (382)..(382): n is a, c, g, or t
  modified_base (489)..(489): a, c, t, g, unknown or other
  misc_feature (489)..(489): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatntggtatgaattgggtgcgacacggcccccggagaagggcttggaggtggggtgggggtgggtcgaggcggtgtttaggacgggtaaggcacgagtatgaccaccggaagatagaaggggcaagngtcaacgattacccacggaccacccccgaagaacacacgtactacatagaccaataggaccgagccgtagagagcgtgaccgaacacggtcccgtactacgttacgnggtacgacggtaataagttcgttttaacgtggttactacttacggttaaactaagttttaggattacgggtaaccttacggttaagtacgggtaaccgttggggtaaccttttcggggtaacccggggg

SEQ ID NO: 339557 - DNA, 583 bp, Homo sapiens
  misc_feature: GZ8MTXP01A17FI.17.10.A10.1.454.CMB.2.raw
  modified_base (492)..(492): a, c, t, g, unknown or other
  misc_feature (492)..(492): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaatatggtatggaattgggtgcgacgacggcccccggagaagggcttggaggtcggggtgggggtgggtcgaggcggtcgtttggaacggtaagggcacgaggtatggaccaaccggaagataggaagggcaagcgtcaacggtacttaccacgggacccaaccccacgaacacagtcaacgatcgacaacgtgacgacgctagagagcggtagacgacacgggccgtctagttacgngtcgtcgaagtattggtttctgttctattccgtaaatattttgattacggtcctgtaagtggaccgttaggtaacgtttcgggtaacgggg

SEQ ID NO: 339558 - DNA, 725 bp, Homo sapiens
  misc_feature: GZ8MTXP01CE35K.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatataggtatgaaagttgggtgcgacgacggcccccggacgaagggcttggaggtggggtgggggtggggtcgaggcggtcgttttggacggtaaggcacgtagtaagtgacccaccggaaagagtaggaaagggcaaggaagtccaaacggaacttaaccccgaaccggggaacccaaccccccaacggaaaacccaccgaacgtacctaacaatgaccgaaacgtacgacggacgcctaggaagacggacgtacggaaccggaccgaaccgggtcccggttaccttaagtttaccgttagggttacggaccggtaacgttaaagttttgggtttttaacccttgggttacccttaaagtttacccggttaaactttaaaggtttttcggttaagttacggggttccttaccgttaaggttacgggtacgtttacgggttaaccgtttcggtttaacccggggggg

SEQ ID NO: 339559 - DNA, 712 bp, Homo sapiens
  misc_feature: GZ8MTXP01D3OYM.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaactaaaatataggtatagaattgggtgcgacgacggcccccggacgaagggcttggaggtggggtgggggtggtcgagtcggtctttaggacggtaaggcacagtatgacccgaaccggaaagagtggaaaggggacaagggaacgtacgaaaccgtaacttaaaccccgaaccggggaacccaaccccccgaaacgaaaccacgaacgtacctaaacacgtacgaaccaaacgtcgaacgacgcccgttagaacgtacggctacgggaaccgaaccgacccgggtaccgttacctagtttaccgtaggtacggtaccggtaataagtttcggtttttcctagggttactacggtttaacccgttaaacttaaagttttcggaagtttaagggtcctttaccgttaagttgggggtaaaccttcgggggttaacccgttttccgggtaaccgggggggg

SEQ ID NO: 339560 - DNA, 624 bp, Homo sapiens
  misc_feature: GZ8MTXP01BAQIV.17.10.A10.1.454.CMB.2.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttanacaaatatggtatgaagttgggtgcgacgacggcccccggagaagggcttggaggtggggtgggggtgggtcgaggcggtcgtttggacggtaaggcacgagtatgaccaccggaagagtaggaagggacaaggcgtacaacggtacttaacccgaacgggaaccaaccccccgaaggaaccacgaacgtactaacagttacgaccaaacgtcgaacgacgccgtaggaacgaggaccgtacggaaccggaccgaccggggtccctacgttaacgttacgtcgtcggtacgtaagtaactttgttttcctgttctaagttcgtaactaatttgattaggtcctgtaagtggacgttcggtaacgtttcggcgggg

SEQ ID NO: 339561 - DNA, 654 bp, Homo sapiens
  misc_feature: GZ8MTXP01BJ7J6.17.10.A10.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (391)..(391): a, c, t, g, unknown or other
  misc_feature (391)..(391): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctcctgcaaggcagtgatatatcttanacaaatntggtatgaatgggtgcgacgacggcccccgganaagggcttggaggtggggtggggtgggtcgaggcggtcgttttagggaacggttaagggctacgagtagtcgaccgaaccggaagagtggaaaggggcaagnggtacgaaacgtacttaaccccgaacgggaccccacccccgaacgaaaccacgtaacgtctaacatacgacaactgaaccgacgcctagagacgtcggtacggaacccggacgaaccggggtccgtacttagttaccgttacgggtgaccggtagtaaagtttcggttttctacggttccttagttaccgttaaataagttttaggagttaaggtcttacgttaagtcggtacgttagggtaaccgtttcgggtaaccggggg

SEQ ID NO: 339562 - DNA, 583 bp, Homo sapiens
  misc_feature: GZ8MTXP01EZHEL.17.10.A10.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (514)..(514): a, c, t, g, unknown or other
  misc_feature (514)..(514): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagtacaggtgcccacgcccaggttcagttggtgcagactggggctgaggtgcagaagcctggggcatcagtgactgtctcctgcaagccagtgatatatcttcacaaatatggtangaattgggtgcgacacgggcccccgganaagggcttggaggtgggggtgggggtgggtcaggcggtctttggacgggtagcacagtatgcacgaagatacggaaagggcaagagtacaacgacttaccgacgggaccaaccccccgacgaaccacacgtactaacatacggacaacgtgacgagcctagagaggctagaccgacgaccgccgtctattactgtgcgaagtaattgttttcngttcagttaccggtaattaagttttgaacttggcttcttagtggttaccgtgggttaaccgtttcgggg

SEQ ID NO: 339563 - DNA, 737 bp, Homo sapiens
  misc_feature: GZ8MTXP01D5IZT.17.10.A10.1.454.CMB.2.raw
  modified_base (253)..(253): a, c, t, g, unknown or other
  misc_feature (253)..(253): n is a, c, g, or t
  modified_base (387)..(387): a, c, t, g, unknown or other
  misc_feature (387)..(387): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttacaanaaaatatggtatgaattgggtgcgacacggcccccggagaagggtctggaggtggggtgggggtgggtcgaggcggtcgtttaggacggtaaggcaacgagtagtgaccaccggaaagagtaggaagggcaagngtacaacgtacttaaccccgaacgggaaccccaaaccccccgaacgaaaccaacgtaacggtacctaacaacgttacggaaccaaacgtcggaaccgaacgtacccgtaggaaggtacggaccggtacgggaaacccggtaacccgacccgggtacccggtttaccttaaacgtttaaccgttggttaccggaacggttaaacgttaaagttttcggtttttcccttagggttacgtaaactttaccgggttaaaccgtttaaatttttacgggaagtttacgggtaacccttacgttaaggttacggggtaccgttagggttaacccgttttcggggtaacccgggggg

SEQ ID NO: 339564 - DNA, 578 bp, Homo sapiens
  misc_feature: GZ8MTXP01DGZTQ.17.10.A10.1.454.CMB.2.raw
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcaggaagccgtggggcatcagtgactgtctctgcaaggccagtgatatatcttacacaaaatatggtatgaattgggtgcgacagggcccccgganaagggcttggaggtggggtgggggtggggtcaggcgggnttttggacgggtaaggcacagtatgccaccggaagntggaaggcagngtcacgattaccgacggacacccccagaacacagtctacatacgacaaacctgaccgagacccgtgaacgagcgtacggaaccggaacaccgggcccgtactacgttactgtgaccgagtaacttggttttctggttctacttcggttaactaatttgattagggtctcgtgtggacttgggtaacttcggtaaccggggg

SEQ ID NO: 339565 - DNA, 598 bp, Homo sapiens
  misc_feature: GZ8MTXP01CFA8T.17.10.A10.1.454.CMB.2.raw
  modified_base (388)..(388): a, c, t, g, unknown or other
  misc_feature (388)..(388): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaatatggtatgaattgggtgcgacaggcccccggagaagggcttggaggtggggtgggggtgggtcgaggcgggtcgttttggacgggtaagggcacgagtatgcccaccggaaagagtaggaaaggggcaaggngtccgaacgtacttacccgaaccgggacccaaccccccgaacgaacacagtactacatcgacaactgacgagcctgagagcgtgaaccgacaccggccgttctaagttactggtgaccggtagtaacttgttttctggttctagttcgtaactatttgattagggtctacgttaagtcggtacgttgggtaacgtttcggtaaccggggg

SEQ ID NO: 339566 - DNA, 582 bp, Homo sapiens
  misc_feature: GZ8MTXP01DJZP4.17.10.A10.1.454.CMB.2.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccgganaagggcttggaggtggggtgggggtgggtcagcggctttggacggtaaggcacagtatgccaccggaagatgaagggcagngtcacgataccacggacaccccgacgaacacagtctacatcgacaactgacgagcctgaagacgcgtacgaacgaaccgaccgggcccgttctaagttactggtcgtacgtaagtaacgtttggtttttcctggttcctagttaccgttaataagttttacggattaagggtcttactaagtgggaccttgggtaaccgtttcggtcggggg

SEQ ID NO: 339567 - DNA, 565 bp, Homo sapiens
  misc_feature: GZ8MTXP01DZRRG.17.10.A10.1.454.CMB.2.raw
  modified_base (253)..(253): a, c, t, g, unknown or other
  misc_feature (253)..(253): n is a, c, g, or t
  modified_base (446)..(446): a, c, t, g, unknown or other
  misc_feature (446)..(446): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcgaaccccccatgtgattcatatgntctggtaccagcaactcccggatcacgcccccaaactcctcatatatagaagaataataagccgaccctcgacggggttcccctgaccgtattcctcgtacggcctccgaagtctggccacgtctcgcccaccctgggcatccaccgcgctccgagacgtggggacaggccgagttatttcgtgccgacaacngtgggcttaccgagtcctgtacttcggtgggggtcttcgggcaggtcgggaacccaaggttccttacggaaccccggttcgtaacgggtccaccggccccgaacgggttccgtccccgg

SEQ ID NO: 339568 - DNA, 636 bp, Homo sapiens
  misc_feature: GZ8MTXP01CMV5S.17.10.A10.1.454.CMB.2.raw
  modified_base (250)..(250): a, c, t, g, unknown or other
  misc_feature (250)..(250): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttnacaaatatggtatgaattgggtgcgacgacggcccccggagaagggtcgttggaggtggggtggggtgggtcgaggcggtcgtttggacggtaaggcacgagtagtgaccaccggaagagtaggaaggcaaggcgtcgaacgacttaccgaccggaccacccccaacgaaccacgacgtactacagtcgacaacgtacgacgacgccgtagacgacgcgtagaaccggtacgaccggtcccgttacgttagttaaccgttggtacggtccgaaggttaacgtttgttttaaccgtcggttactacgttacgttaaactagtttacgttagttacgggtcttacgtaagttcgggtacgttcgggttaacgttcgggtaaccggggg

SEQ ID NO: 339569 - DNA, 636 bp, Homo sapiens
  misc_feature: GZ8MTXP01AJ3HI.17.10.A10.1.454.CMB.2.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaattgggtgcgacacggcccccgganaagggcttggaggtgggggtgggggtgggtcgaggcgggtcgtttaggacggtaaggcaacgagtatcgaccaaccggaagacgtgggaaagggcaaggaagtccgaacgtacttacccgacgggacccacccccgaaacgaaccacagtactacatcgacaactcgaacgagtcctaggagagcgtagaaccggacaacccgggtccgtcttaagttaccgtaggtgaccggtaagtaagtttcggttttctggttcaagttccggttaaactaaagttttcgagttacgggtccttagttaacgttgggtaccgttagggttaaccgttcggtcccgggggg

SEQ ID NO: 339570 - DNA, 613 bp, Homo sapiens
  misc_feature: GZ8MTXP01CWM8B.17.10.A10.1.454.CMB.2.raw
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacacggcccccgganaagggcttggaggtggggtgggggtggggtcgaggcgggtcgttttggacggtaaggcacgaggtatgaccaccggaagagtaggaaggcagngtcgaacgacttaccgaccggaccacccccgaacgaacacacgtctacatcgacaacgtgacgacgccgtagacgacgcggtacggaccggaccgaccgggccgttacgtaacgtttacgtggttgaccgtagtaagtttgttttctcgttactacgttacgttaacgtattttaggattacgggtcttcgtaagtcgggtacgttgggtaaccgtttcgggtaaccggggg

SEQ ID NO: 339571 - DNA, 672 bp, Homo sapiens
  misc_feature: GZ8MTXP01AYH4U.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaatatggtatgaattgggtgcgacgacggcccccggagaagggcttggaggtggggtgggggtgggtcgaggcggtcgtttggacggtaaggcacgagtagtgccaaccggaagagtaggaagggacaaggaacgtacaaaccgggtaacttaaccccgaaccggaacccaacccccccgaacgaaacctacgaacggtacctaacagtacggaccaaacgtcgaaccgacgcccgtaggaacgacggacgtacggaaccgacccgaaccgggtcccgttacttaacgtttaaccgtggttcggaccggtaagttaaacgtttggttttaacctggttacctagttaccggttaactaagtttagacgttaggtcttcgttaagtcgggaaccgttgggtaaccgtttcgggtccggggg

SEQ ID NO: 339572 - DNA, 628 bp, Homo sapiens
  misc_feature: GZ8MTXP01ALUE1.17.10.A10.1.454.CMB.2.raw
  modified_base (387)..(387): a, c, t, g, unknown or other
  misc_feature (387)..(387): n is a, c, g, or t
  modified_base (460)..(460): a, c, t, g, unknown or other
  misc_feature (460)..(460): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatagaattgggtgcgacgacggcccccggagaagggcttggaggtggggtgggggtgggtcgaggtcggtcgtttggacggtaagggcacgagtatgccaaccggaagagtaggaaggggacaggngtcaacgacttaccgacggaccacccccacgaacacagtactacatgaccaatcgacgagcctagacgagcgnggaacgacgaccgggtctacgtattaccgtgtacgcgtaagtaagtttcggttttcctggtttcctacgtttacccggttaaacgttaattttcggaacgttaagggtcctttaccgttaaggttacgggtaacgttcgggtaaccgtttttcgggtaacccgggggg

SEQ ID NO: 339573 - DNA, 605 bp, Homo sapiens
  misc_feature: GZ8MTXP01DY17V.17.10.A10.1.454.CMB.2.raw
  modified_base (406)..(406): a, c, t, g, unknown or other
  misc_feature (406)..(406): n is a, c, g, or t
  modified_base (535)..(535): a, c, t, g, unknown or other
  misc_feature (535)..(535): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtggatatatcttacaacaaatatggtatgaagttgggtgcgacgacggcccccggagaagggtcgttggagggtggggtgggggtgggtcgaggtcgggtcgttttagggaaccgggttaagggcaacgtaggtagtcgacccgaaccggaagagtaggaagggacagngtcacgtactaccgacggaccaccccagacacagtcacatgacaacgtcgacgacgccgagacgagcgacggaccgacgaccggtccgttactagttaccgtggtacgacgtagttaacgtttggtttntcgttattacgttacgtaattaagtttgagttagtctagtaagtggtacgttggtcgttggtaaccgggg

SEQ ID NO: 339574 - DNA, 575 bp, Homo sapiens
  misc_feature: GZ8MTXP01B3K80.17.10.A10.1.454.CMB.2.raw
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggccccccgganaagggcttggaggtggggtgggggtgggtcgagcggctttggacggtaaggcacgagtatgccaccgaagatggaagggacagngtcaacggattacccgacgggaccacccccgaacgaaccacacgtctaacatgacaactgacgagcctagagagcgtaggaccggacaccgggccgtctacttacgtgtcgcgtaagtaattggttttaactgttaccattcgtaaactaattttgacttaggcttcgtaagtggtacttggtaacgttcggtaacggggg

SEQ ID NO: 339575 - DNA, 673 bp, Homo sapiens
  misc_feature: GZ8MTXP01D1RQ3.17.10.A10.1.454.CMB.2.raw
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtgatatatcttanaacaaatntggtatgaattgggtgcgacgacggcccccggagaagggcttggaggtggggtggggtggtcagcggtctttggacggtaaggcacgagtagtgaccaccggaagagtggaaaggggcaaggaacgtcgaacgtaacttaacccgaaccggggacccaaccccccgaaacggaaccaacgaacggttacctaaacaagttcggaaccgaaactacgggaaccgaagccccgtaggaaacggcgtacggtacggaacccggaaaccgcccgggtaaccgttacctaagtttacgtcggtaggtaccggtaaggtaaatttcgggttttaactcggttactaacttcggttaaactaagttttagagttacgggtcttagtaagttcgggacttagggtccgttcgggtaaccggggg

SEQ ID NO: 339576 - DNA, 676 bp, Homo sapiens
  misc_feature: GZ8MTXP01DFO9M.17.10.A10.1.454.CMB.2.raw
  modified_base (393)..(393): a, c, t, g, unknown or other
  misc_feature (393)..(393): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaaggccagtggatatatcttacaacaaaatatggtatgaagttgggtgcgacgacggcccccggagaagggcttggaggtggggtgggggtgggtcgaggcgggtcgtttgggaacgggtaaggcacgagtatgacccaaccggaaagagtaggaaggggacagngtacacgtacttacccgaccggaccacccccgaacgaacacacgtactacatagacaacgtagacgacgccgtaggagacgcggtacggaaccggtaccgaccgggtcccgtacgttacgttaccgttggtcgtaccggtaagttaacgtttgggtttttccttgggttaccttaaacgttaccgtttaaaccgttaaagttttacggttaagttaacggggttcttaccgttaaggttgggtaaccggttcgggttaaccgtttcggggttaacccgggggg

SEQ ID NO: 339577 - DNA, 775 bp, Homo sapiens
  misc_feature: GZ8MTXP01A1GDF.17.10.A10.1.454.CMB.2.raw
  modified_base (206)..(206): a, c, t, g, unknown or other
  misc_feature (206)..(206): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccgganaggaggtcaccatctctgctctcgaacccccatgtgatcatatgtgtctggtaccagcaactccggatcacgaccccaactcctcatatatagaagaataaagtaacgccgaacccgtcgtacggggttccccctaggaccgtatttcctcgtacggtcctccaaagtcctcgggacctacgtccgtcgaccccgtacccgttggggacctaacgtcccgacccggaccgtacccgttaccccggaacggtacccgggttacggggggtaaacccggaaccggggtaccccggttaaacggtttaacgggttttcccggtacgggttaccgacccgtaaaccggtaacggttacggggtaaacctttccccgaaacggttccccgttcggtaacccggtttttcccggggtggggggtttccggtttcggggacccggttaagggggttacccgggggaaacccttaacgggttcccgttaccgggtaacccccggtttcccggttaaacggggttcccgtaaaccccgggaccccgtaaccggggttccccgtttaacccccccgggg

SEQ ID NO: 339578 - DNA, 657 bp, Homo sapiens
  misc_feature: GZ8MTXP01CE6IJ.17.10.A10.1.454.CMB.2.raw
  modified_base (248)..(248): a, c, t, g, unknown or other
  misc_feature (248)..(248): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtgatatatcttnacaaatatggtatgaagttgggtgcgacgacgggcccccggagaagggtcgttggaggtgggggtgggggtgggtcgaggtcgggtcgttttaggaacgggttaaggcacgaggtagtcgacccgaaccggaagagtaggaagggacaaggcgtacgaacgtacttaacccgaaccgggacccaacccccgaacgaaaccacgacgtactaacatacgaccaaacgtgaacgacgccgtagacggacgccggtacggaaccggaccgtaaccgggtccgttactacgtttacgtacggtacgtacgtaagttaacgtttgttttctggttacctagttaccgttaagttaagtttagagttacggtcttacgtaacgtggtacgttacggtccgttcggtaaccggggg

SEQ ID NO: 339579 - DNA, 534 bp, Homo sapiens
  misc_feature: GZ8MTXP01CUBJ3.17.10.A10.1.454.CMB.2.raw
  modified_base (471)..(471): a, c, t, g, unknown or other
  misc_feature (471)..(471): n is a, c, g, or t
tcagcgtagactagcacgaccggtgctcgatttagcgtcgatctcaggggacccaaaaaccacacccctccttgggagaatcccctagatcacagctcctcaccatggactggacctggagcattcttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggagaagggcttgagtgggtggggtggtcagcggctttgacgataggcacagtatcgcacgaagatgaaaagggcaagagtcagactacacggacaccccagaacacagtctaacatgacaacgtgacgagcctagagacggctagacgacgacgccgtactattactgtgcgagtaatgttttcngttcagttacgtacttaagtttgagttaacggacttcgtagtgggacttgggaacgtttcggg

SEQ ID NO: 339580 - DNA, 609 bp, Homo sapiens
  misc_feature: GZ8MTXP01B96VK.17.10.A10.1.454.CMB.2.raw
  modified_base (273)..(273): a, c, t, g, unknown or other
  misc_feature (273)..(273): n is a, c, g, or t
  modified_base (396)..(396): a, c, t, g, unknown or other
  misc_feature (396)..(396): n is a, c, g, or t
  modified_base (464)..(464): a, c, t, g, unknown or other
  misc_feature (464)..(464): n is a, c, g, or t
  modified_base (526)..(526): a, c, t, g, unknown or other
  misc_feature (526)..(526): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggcagtgatatatctacaacaaatgtgtatgaagttgggngcgacgacggccccgagaagggtcgtggagggtggggtgggggtgggtcgaggtcgggtcgtttagggaacgggttaaggccagagtagtagaccgaacggaaggtagaggaagggacaaggngtaccgaacgtaactacccgaaccggaccccaaccccaaagaaccatacgtactacatcgactaacgngacgacgccgagacgacgacgacggaaccgaccgacgggtccttattaacgtcgtggtacgngtaagtactttgtttctgttctagttcgttaattagttgagttcgtctagtgtcggtagttcggtaacgttcggtaacggggg

SEQ ID NO: 339581 - DNA, 536 bp, Homo sapiens
  misc_feature: GZ8MTXP01DQMXF.17.10.A10.1.454.CMB.2.raw
  modified_base (366)..(366): a, c, t, g, unknown or other
  misc_feature (366)..(366): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggggtgggtcagcggctttgaacggtaggcacagtatgccaccgaagatggaagggcagngtcacgattaccacgggacacccccacgaacacagtctaacatgacaaactgaacgagccagacgagcgtgacgacgaccgccgtcctattacctgtgcagtaattgtttctgttctattccgtaanatttgnttaggctctaatggacttggtaacgttcgtaacgggg

SEQ ID NO: 339582 - DNA, 575 bp, Homo sapiens
  misc_feature: GZ8MTXP01CL6JD.17.10.A10.1.454.CMB.2.raw
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
  modified_base (531)..(531): a, c, t, g, unknown or other
  misc_feature (531)..(531): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaattgggtgcgacacggcccccggagaagggcttgaggtggggtggggtggtcgaggcggtcgtttggacggtaaggcacgagtntgaccaccggaagagtaggaagggacagngtcaacgataccgacggacccaccccagaacacagtctacatgacaaactgacgagcctagagagcgtagaacgacgaacggccgtacgtattacgtgtgcgtaagtagttggtttcctgttctattcgttaactaagtttagattacgggtntacgttaatgggtacgttacgggtaacgttcgggtaaccggggg

SEQ ID NO: 339583 - DNA, 598 bp, Homo sapiens
  misc_feature: GZ8MTXP01A12NT.17.10.A10.1.454.CMB.2.raw
  modified_base (274)..(274): a, c, t, g, unknown or other
  misc_feature (274)..(274): n is a, c, g, or t
  modified_base (324)..(324): a, c, t, g, unknown or other
  misc_feature (324)..(324): n is a, c, g, or t
  modified_base (475)..(475): a, c, t, g, unknown or other
  misc_feature (475)..(475): n is a, c, g, or t
  modified_base (553)..(553): a, c, t, g, unknown or other
  misc_feature (553)..(553): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaattgggtncgacacggcccccggagagggctggagtggggtggggtgggtcagcggtntttggacggtaaggcacgagtatgaccaaccggaagagtaggaagggacaaggtaacgtaccgaacgtaacttaacccgaccgggaacccaaccccccgaacgaaccaacacggtactacaattcgacaacgtcgacgacgcctaggacgngcgtaggaccgaccaccgggtcttctatttacgtgtagtacgataagttgtttctgttctattcgtaactaagtttgnttacggtctacgtaagtcggacgttaggtcttcgggtaacggggg

SEQ ID NO: 339584 - DNA, 571 bp, Homo sapiens
  misc_feature: GZ8MTXP01DRY8K.17.10.A10.1.454.CMB.2.raw
  modified_base (289)..(289): a, c, t, g, unknown or other
  misc_feature (289)..(289): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacacaaaatatggtatgaattgggtgcgacacggcccccgganaagggcttggaggtggggtgggggtgggtcaggcggtctttggacggtaaggcacagtatgcaccgagagtgaaggcagngtcacgacttaccgacggacaccccgagaacacagtactacatgacaacgtgacgagcctgagacgcgtacgacgtacgacggccgtctagttaccgtagtcgtacgtagtaagttgttttaactggttctagttcgtaactagtttagattacgggtcttacgtaagttcgggaccttgggtaacgttcggtaaccggggg

SEQ ID NO: 339585 - DNA, 659 bp, Homo sapiens
  misc_feature: GZ8MTXP01A0CBB.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaagttgggtgcgacgacggcccccggagaagggcttggaggtggggtgggggtgggtcgaggcggtcgtttgggacggtaaggcgacgagtagtagacccgaccggaaggatagggaacgggacaaggaacgtcgaacgtacttacccgaaccgggaccaacccccgaacgaaccactacggtactacatagaccaactcgaacgagcccgtaggacgacgcggtacgacggaccgaccgggtccgttacgttaacttaccgtagttcggacggtaagtaacttttgtttaacttcggttactaacgttacggttaaccttaagttttacgttgttacgggtaacttccgttaagtcgggtacgttacggttccggttcgggttaaccggggg

SEQ ID NO: 339586 - DNA, 655 bp, Homo sapiens
  misc_feature: GZ8MTXP01ATYA0.17.10.A10.1.454.CMB.2.raw
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatcttacaacaaatntggtatgaagttgggtgacgaacgacggcccccggagaagggtctggagggtggggtgggggtggtcgaggtcggtgttttagggaacgggtaaggccaagtagtagtcggaccaaccggaagagtagggaagggcaaggcgtcaacgggtaactaacccgaaccggacccaaaccccccgaagaaaccacgaacgtacctacgagttcgaactaacctaggaccggacgcccgtaggaacgacgacgtacggaaccggacgacccggtaccgtactagttacgtgtacgcgtaagtagtttgtttctggttacctagttacgtaaacgtaatttcggagttaacggtccttagttaaggttcggaccgttgggtaaccgtttcgggtaaccggggg

SEQ ID NO: 339587 - DNA, 613 bp, Homo sapiens
  misc_feature: GZ8MTXP01A1XZ3.17.10.A10.1.454.CMB.2.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttgggggaagaggaagactgaccggtccccccaggagtacaggtgcccacgcccaggttcagttggtgcagactggggctgaggtgcagaagccgtggggcatcagtgactgtctcctgcaaggccagtgatatatctnaacaaatntgtangaattgggtgcgacacggcccccgganaagggcttggaggtgggggtgggggtgggtcaggcggtctttggacggtaaggcacgagtatcgacacgaagataggaaagggcaagacgtacaacggactacccgacggacccaacccccacgaaccacacgtactaacatacgacaacgtcgaacgacgcctagacgacggcgtacggaaccgaccgaccggtcccgtacgttacgttaccgtggtacgacgtaagtaatttggtttcttgttcttacgttacgttaacttaagtttgaagttaaggtcttcgtagtcggacgtcggttaacgttcgggg

SEQ ID NO: 339588 - DNA, 548 bp, Homo sapiens
  misc_feature: GZ8MTXP01AERMS.17.10.A10.1.454.CMB.2.raw
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaatatggtatgaattgggtgcgacacggcccccggagaagggcttggaggtggggtgggggtggggtcaggcggtcgtttggacggtaaggcacgagtatgccaccggaagagtggaagggcagaagtcaacgattaccgacgggaccaccccgaacgaccacgacgtactacatgacaactcgacgacgccgtagagagacgtgacgaccacggccgtctattcgtgtgcgtagtattgttttcngttcattcgtataatttgattggntctaatggacttgtaacgttgtcgggg

SEQ ID NO: 339589 - DNA, 609 bp, Homo sapiens
  misc_feature: GZ8MTXP01D48PX.17.10.A10.1.454.CMB.2.raw
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (384)..(384): a, c, t, g, unknown or other
  misc_feature (384)..(384): n is a, c, g, or t
  modified_base (436)..(436): a, c, t, g, unknown or other
  misc_feature (436)..(436): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttanaactaaatntggtatgaattgggtgcgacgacggcccccggagaagggcttggaggtggggtggggtgggtcaggtcggtcgtttggaacggtaaggcactagtatgaccaccggaagagtggaaagggcaaggngtacacgtaactaccgacggaccacccccgaagacacagtcacatgactacngacgagccgtagagacgacgtacgaaccggacgaccggtccgttactacgtttaccgtagttcggaccgtaagttaagtttgttttaactgttactagttaccgttaataagtttagttgttaacggtcttgtaagtcgggtaccttgggttaaccgttcgggtaaccggggg

SEQ ID NO: 339590 - DNA, 666 bp, Homo sapiens
  misc_feature: GZ8MTXP01B5AD8.17.10.A10.1.454.CMB.2.raw
  modified_base (257)..(257): a, c, t, g, unknown or other
  misc_feature (257)..(257): n is a, c, g, or t
  modified_base (399)..(399): a, c, t, g, unknown or other
  misc_feature (399)..(399): n is a, c, g, or t
  modified_base (573)..(573): a, c, t, g, unknown or other
  misc_feature (573)..(573): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctctgcaagcagtgatatatcttacaacaaatntggtatagaagttgggtgcgacgacgggacccccggagaagggtcgtggagggtgggggtgggggtgggtcgaggtcggtcgtttagggacgggtaaggcacgtagtagtcgacccaacggaagagtaggaaggggacaggngtacaacggtactacccgaaccggacccaacccccaacgaacactacgtactacattcgaactaacgtcgaacggacgccgtaggaacgacgtcgacggaaccgtaaccgaccgggttacccgtacttaacgttaacgtcggtaggtaccgtaagttaacgttttgttttaacnggttacctagttacgttaaacgtaattttcggttattacggttctacgttaagttcgggtacgttagggtaaccgttttcggggaaccggggg

SEQ ID NO: 339591 - DNA, 651 bp, Homo sapiens
  misc_feature: GZ8MTXP01BQQ4O.17.10.A10.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagccgtggggcatcagtgactgtctcctgcaaggccagtggatatatctacanaaaatntggtatgaattgggtgcgacgacggcccccgagaagggtcttggaggtggggtggggtgggtcgaggcggtcgtttggacggtaaggcaacgagtatcgacccgaccggaagagtaggaaagggcaagggtaacgtcgaacgtattaacccgaccgggaacccacccccgaacgaaaccacaacgtacctaacgacgttagaccgtaaacgtggaaccggacgacccgtaggaagaccggacggtacggaaccgacgaaccgggtccgttacctagttaccgtggttcgagtaggtaactttgtttcgtgttactacgttccgttaaagtaagttttcgagttcggtaacctagtaacgttggtacgttcggtaacgtttcgggaaccggggg

SEQ ID NO: 339592 - DNA, 700 bp, Homo sapiens
  misc_feature: GZ8MTXP01CQW3G.17.10.A10.1.454.CMB.2.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagccgtggggcatcagtgactgtctctgcaaggcagtgatatatctcanaaatntggtatgaattgggtgcgacacggcccccgagaagggctggaggtgggtgggggtggtnaggcggtcgtttagggacgggtaacggcaacgaggtatgcccgacggaaagngtaggaagggacagngtcaacgattaccgaccggaccaacccccagaaccncagtactacatcgacaaacgtgaacgtagcccgtaggaacgacgcggttaacgaaccggaccgtacccgggtacgttaccgttaacgtttacgttacgggttacgaccgggtaaagttaaacggttttcgtttttaacgtacggtttccttaaacgttacccggtttaaaacttaagtttttacgggaagtttaacggggttccccttttaaggttaacggttttacggggaaaccccgttttgggggttaaacccgtttttccgggggtaaccccgggggggg

SEQ ID NO: 339593 - DNA, 596 bp, Homo sapiens
  misc_feature: GZ8MTXP01ALBCH.17.10.A10.1.454.CMB.2.raw
  modified_base (395)..(395): a, c, t, g, unknown or other
  misc_feature (395)..(395): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtggatatatcttcaacaaaatatggtatgaagttgggtgcgacgacggcccccggagaagggcttggaggttggggtgggggtggggtcgaggtcgggtacttttgggaacgggttaaggcaacgagtatcggaccaaccggaagagtaggaagggcaagngtacgaacgtattacccgacggaccaccccccaacgaaccacgacgtactaacatagacaactcgaacgagccgtaggagacgcggtacgaaccgaccgaccgggtccgttctattacgtgtcgcgaagtaattggtttctgttctattccgtaataatttgagttagtctagtaagtggacgttggtaacgttggtcggg

SEQ ID NO: 339594 - DNA, 580 bp, Homo sapiens
  misc_feature: GZ8MTXP01CBADR.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaagttgggtgcgacgacgggccccccggagaagggcttggaggtggggtgggggtgggtcgaggcgggtgtttggacggtaaggcacgagtatcggacccaccggaagagtaggaagggacagaagtcaacgtactacccgacggacccacccccgagaacacagtctacatgacactagacgacgcctagagagcggtagaaccggacaccgggtccgtactagttacgtgtcgcgtagtattgtttctgttctattcgtatattgagttaggtctacgtaagtcggacttaggtaaccgttcggtaaccgggg

SEQ ID NO: 339595 - DNA, 539 bp, Homo sapiens
  misc_feature: GZ8MTXP01DU7LC.17.10.A10.1.454.CMB.2.raw
  modified_base (367)..(367): a, c, t, g, unknown or other
  misc_feature (367)..(367): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggtgggggtgggtcagcggctttgacggtaaggcacagtatgccaccggaagatgaagggcagngtcacgattaccacgggacacccccacgaacacagtcacatgacaactgacgagcctgagagcgtgacgacacggccgtctattactgtgcgagtaattggttttctgttcattcgtaactaatttgattgggctctaagtcggtacttgggtaaccttcggtaaccggggg

SEQ ID NO: 339596 - DNA, 603 bp, Homo sapiens
  misc_feature: GZ8MTXP01CDUKM.17.10.A10.1.454.CMB.2.raw
  modified_base (393)..(393): a, c, t, g, unknown or other
  misc_feature (393)..(393): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaatatggtatgaagttgggtgcgacgacgggccccccggagaagggtcttggagggtggggtgggggtgggtcgaggcggtcgtttgggaacgggtaaggcacgtagtatgacccgaccggaagagtaggaagggacagngtcacgacttaccgacggaccacccccgagaaccacacgtactacatgacaacgtagacgacgccgtagacgacgacgtacggaccgacgaccggtaccgtctagttaccgtgtcgtacgagtaatttggttttaactgttactattccgtaatatttagagttacggtcttcgtaagtggtacgttggtaaccgttcggtaaccggggg

SEQ ID NO: 339597 - DNA, 741 bp, Homo sapiens
  misc_feature: GZ8MTXP01CXX6Q.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctctgcaaggccagtggatatatcttacaacaaatatggtatgaattgggtgcgacgacggcccccggagaagggcttggaggtggggtgggggtggggtcgaggtcgggtcgttttgggaacgggtaaggcaacgtaggtatggaccaccggaaagagtaggaaagggcaaggaagtacaacgtaacttacccgaacgggaacccaccccctaaacggaaaccacgtaacggtacctaacaacgtacgacctaaacgtacggaaccggacgcccgtaggaacggtacggaccgttaacggaacccggtaaccgaacccggggtcccgttaacgtaacgtttacccgttagggtacgtaccgggtaaaggttaaacgttttcgggtttttaaccttcggttaaccgttaacgttacccgggtttaaaccttaagtttttaggaacgttacggggttaacctttaccgttaaggttacgggtacggttacgggttaaccggtttcgggtaaccccgggggg

SEQ ID NO: 339598 - DNA, 582 bp, Homo sapiens
  misc_feature: GZ8MTXP01DQNW7.17.10.A10.1.454.CMB.2.raw
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagtacaggtgcccacgcccaggttcagttggtgcagactggggctgaggtgcagaagcctggggcatcagtgactgtctcctgcaaggccagtggatatatcttcacaaaatntggtatgaattgggtgcgacgacggccccccgganaagggcttggaggttgggggtgggggtgggtcgaggcggtcgttttggacgggtaaggcacgagtatcgacacgaagatgaaagggcaagagtcaagactacccacgggaccacccccaacgaacacagtctacatacgacaactgacgaagcctagagagggctggaacgacgacgccgtactattactgtgcgagtaattgtttcttgtcagttcgtaacgttaatttgaagttgggtactttaagtggtacgttggtaacgttcggtaaccggggg

SEQ ID NO: 339599 - DNA, 571 bp, Homo sapiens
  misc_feature: GZ8MTXP01D501E.17.10.A10.1.454.CMB.2.raw
  modified_base (380)..(380): a, c, t, g, unknown or other
  misc_feature (380)..(380): n is a, c, g, or t
  modified_base (427)..(427): a, c, t, g, unknown or other
  misc_feature (427)..(427): n is a, c, g, or t
  modified_base (546)..(546): a, c, t, g, unknown or other
  misc_feature (546)..(546): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacacaaaatatggtatgaattgggtgcgacgacggcccccggagaagggcttggaggtggggtgggggtgggtcgaggcggtctttggacggtaaggcacagtatgccaccggaagagtggaagggcaagngtacaacgacttacccgacggaccacccccgaacgaacacagtacanatagacaactgaacgacgccgtagaacgagcggtacgaaccgaccgaaccgggccgtactacgttacgtagttgacgagtaattggtttctgttctattcgtaactattgattaggctntgtggacttggtcgttggtcggggg

SEQ ID NO: 339600 - DNA, 627 bp, Homo sapiens
  misc_feature: GZ8MTXP01DCB4W.17.10.A10.1.454.CMB.2.raw
  modified_base (246)..(246): a, c, t, g, unknown or other
  misc_feature (246)..(246): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaagcagtgatatatctanacaaatatggtatgaattgggtgcgaacgacggcccccggacgaagggctttggaggtggggtgggggtgggtcgaggcggtcgtttggaacgggtaaggcacgagtatgaccaccgaagagtaggaagggacagcgtacaacgaacgttaacccacggaccaaccccaacgaacacagtactaacatacgacaacgtgacgagccagagagcgtagacgacgacgggcctactattacgtgtcgagtaagtaagtttggttttaactgttactaacgttaccggttaaactaaagtttttacggaacgttaggggtaaccctttacgttaaggttcgggttaaaccggttgggttaaccgtttcgggttaacccgggggg

SEQ ID NO: 339601 - DNA, 533 bp, Homo sapiens
  misc_feature: GZ8MTXP01APSKN.17.10.A10.1.454.CMB.2.raw
  modified_base (288)..(288): a, c, t, g, unknown or other
  misc_feature (288)..(288): n is a, c, g, or t
  modified_base (371)..(371): a, c, t, g, unknown or other
  misc_feature (371)..(371): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccgganaagggcttggaggtggggtgggggtggggtcaggcggctttggacggtaaggcacagtatgccaccgaagatggaagggcagngtcacgattaccacggacacccccagaacacagtctacatgacaaactgacgagccctgagagctgacgacacgggccgtntattactgtgcgagtaattgtttcngttcattcgtaactaatttgnttaggctntaatggacttgggaactttcgcggggg

SEQ ID NO: 339602 - DNA, 662 bp, Homo sapiens
  misc_feature: GZ8MTXP01BTQKT.17.10.A10.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggccagtgatatatcttacanaaatntgtatgaagttgggtgcgacgacggcccccggagaagggcttggagggtggggtgggggtgggtcgaggcgggtcgtttagggaacggtaaggcaacgtaggtatcggacccgaaccggaaaggagtagggaaacggggcaaggcgtaccaaacggtaacttaaccccgaaccgggaaccccaaaccccccgaagaaaccacgtaacgtactaacacttgaaccaacgtgaacgacgccgtagacgagacggtacggaaccgaaccgaccgggtccgtacttacgttacgtggtcgtacgtaagttaagttgtttctgttacgtacttaccgttaaataagttttagagttacgggtccttagttaagtggtacgttaggtaaccgtttcgggtaaccggggg

SEQ ID NO: 339603 - DNA, 639 bp, Homo sapiens
  misc_feature: GZ8MTXP01ADSYS.17.10.A10.1.454.CMB.2.raw
  modified_base (379)..(379): a, c, t, g, unknown or other
  misc_feature (379)..(379): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaatatggtatgaattgggtgcgacgacggcccccggagaagggcttgaggtggggtgggggtgggtcgaggcggtctttggacgggtaaggcacgagtatgccaccggaagagtaggaagggacagngtcaaacgtattaacccgacgggacccaacccccgaacgaaaccacagtctacatcgaccaacgtgaccgagccgtaggagacgcggtacggaaccgaccgaccgggccgtctagttaacgtcggtacgtaccgaaaggttagttcggttttaacgtcgttacctagttacccggtaaacttaagttttcggttagttacgggtcttaccgttaagttcgggtaacgttcggggtaaccgtttcggggtaacccgggggg

SEQ ID NO: 339604 - DNA, 629 bp, Homo sapiens
  misc_feature: GZ8MTXP01DNQX7.17.10.A10.1.454.CMB.2.raw
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggccagtggatatatcttanaacaaatatggtatgaagttgggngcgacgacggcccccggagaagggctggaggtggggtggggtgggtcaggcggtcgtttggacggtaaggcacgagtangaccacggagagcggaaggcagcgtacaacgtaacttacccgacgggacccacccccgaacgaaacctacacggtaccctaaacgacgtacgacgaacgtacgacgacgacgagacgacgacggtacgaccggaccgaccggtaccgtacgttacgttacgtacgtcgtacgtagttagtttgtttcgttcgttactacttacgttaacgttagttagttcgttacgtcgttacgttaacgttcggtacggttacggtcggttcgggtcgggg

SEQ ID NO: 339605 - DNA, 604 bp, Homo sapiens
  misc_feature: GZ8MTXP01AVWY3.17.10.A10.1.454.CMB.2.raw
  modified_base (385)..(385): a, c, t, g, unknown or other
  misc_feature (385)..(385): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatatggtatgaattgggtgcgacgacggcccccggagaagggtcttggaggtggggtgggggtgggtcgaggcggtcgtttggacggtaaggcacgagtatgacccaaccggaagagtaggaagggcagngtcacgtatacccgacggacccacccccgaagaaccacacgtactacatgacaacgtgacgagcctaggacgacgcgtagaccgaccgacgggtccgtactattacgtgtgtacgtaagtacgtttggttttctggttctacgttcggttaacttaagtttgacgttacggtccttacgttaaggtggtacgttcgggtaacgtttcgggaaccggggg

SEQ ID NO: 339606 - DNA, 702 bp, Homo sapiens
  misc_feature: GZ8MTXP01BSQ6I.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatatggtatgaagttgggtgcgacgacggcccccggagaagggtcttggagggtggggtgggggtgggtcgaggtcgggtcgtttggaacgggtaaggcaacgtagtagtcgacccgaaccggaagacgtaggaaggggacaaggtaagtaccaaacgtacttaacccgaaccgggaacccaaccccccgaacgaaaccacgtacggtacctaacgacgttacggacctaaacgtcggaaaccggacgtacccgtaggaacgtacggccgtacgggaaccggtaaccgacccgggtacccgttacttaacgttacgtcgggttacggaccggtaagtaacgtttcgttttaacgtacggttactaacgtttcggtaaacttaagtttacggagttacgggtctacgtaaggtcggtacgttcgggtaaccgttcgggtaaccggggg

SEQ ID NO: 339607 - DNA, 582 bp, Homo sapiens
  misc_feature: GZ8MTXP01BWW69.17.10.A10.1.454.CMB.2.raw
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctctgcaaggcagtgatatatcttacacaaatatggtatgaagttgggtgcgacgacggcccccggagaagggtcttggaggtggggtgggggtgggtcgaggcggtntttggacggtaaggcacgagtatgccaccggaagagtaggaaggcagngtcacgattaccgacggaccaccccaacgacacacgtctacatgacaactgacgagccgtagagacgcgtacgacgaccgacgggtccgtctagttacgtgtaggtcgtaagtaagtttgtttctgttctattcggtaactaagtttcgagttacgggtcttacgtaacgttggacgttgggtaaccgttttcggtaaccggggg

SEQ ID NO: 339608 - DNA, 614 bp, Homo sapiens
  misc_feature: GZ8MTXP01EAQVM.17.10.A10.1.454.CMB.2.raw
  modified_base (542)..(542): a, c, t, g, unknown or other
  misc_feature (542)..(542): n is a, c, g, or t
  modified_base (566)..(566): a, c, t, g, unknown or other
  misc_feature (566)..(566): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaatatggtatgaattgggtgcgaacgacggccccccggagaagggtctttggaggtgggggtgggggtgggtcgaggtcggtcgttttagggaacggttaggctacgagtagtcggaccaccggaaagcgtaggaagggcagcgtacgaacgtacgttaacccgacgggacccaaccccgaacgaacacaggtactacatacgacaacgtgaaccgagccgtagagacgcgtacgacgaccgaccgggccttacgtagttacgtggtagtacgtagttagttgttttcngttctacttcgtaaactaatttgngttacggcttataagtggtattacgggtaacgtttcggtaaccggggg

SEQ ID NO: 339609 - DNA, 736 bp, Homo sapiens
  misc_feature: GZ8MTXP01CSM7N.17.10.A10.1.454.CMB.2.raw
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaagccagtgatatatcttacaacaaatntggtatagaagttgggtagcgacgacggcccccggaagaagggtcttggaggtggggtgggggtggtcgaggcggtcgttttagggaacggtaaggcaacgtagtagtggaccccaaccggaaggagtagggaaagggcaagaacgttacgaacgtaaacgttaacccgaaccgggaaccccaaccccccgaaacgtaaacaactacggtacctaacaacgtacgaacctaaacgtggaaccgtacgacccgtaggaacggtacgaccggtacggaaaccggaacccgtaccgggacccgttacgttaaacgtttaccgtacggttagaccgttaaagtaaccgttttgttttaacgtacggttaccttaaacgttacccggtttaaactaagtttttacggaagttacggggttcccttaacgttaaggttaccgggtacgttacgggttaaccgttttcggggtaaccccgggggg

SEQ ID NO: 339610 - DNA, 627 bp, Homo sapiens
  misc_feature: GZ8MTXP01A04GS.17.10.A10.1.454.CMB.2.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccgganaagggctttggaggtggggtgggggtggtcgaggcggtgtttggacggtaagcacagtatcgaccaccggtaagagtaggaaagggcaaggaagtcgaacgtacttacccgaccggaacccacccccgaaacgaaccacacgtactacatgacaacgtgacgagccaggagacgcgtacgaccgacgaccggtccgtactacgttacgtgtcgcgtaagttaagttggttttcctaggttctaacgttacgttaaacgttaagttttacggacgttagggtccttacgttaaggttcgggtaaccgttgggtaacccgtttcgggtaaccgggggg

SEQ ID NO: 339611 - DNA, 535 bp, Homo sapiens
  misc_feature: GZ8MTXP01CUL7N.17.10.A10.1.454.CMB.2.raw
  modified_base (363)..(363): a, c, t, g, unknown or other
  misc_feature (363)..(363): n is a, c, g, or t
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggacaagggcttggagtggggtggggtgggtcagcggctttgacggtaagcacagtatgccacgaagatgaaggcagngtcacgataccacggaccaccccagaacacagtctacatgacaactgacgagcctgagacgcgtgaccgacaccggccgtctacttacgtgtgccgtaataattgttttctgttctattcgtaactatttcgattaggctntaagtggccttggtaaccttggtaacggggg

SEQ ID NO: 339612 - DNA, 672 bp, Homo sapiens
  misc_feature: GZ8MTXP01B2HIG.17.10.A10.1.454.CMB.2.raw
  modified_base (290)..(290): a, c, t, g, unknown or other
  misc_feature (290)..(290): n is a, c, g, or t
  modified_base (379)..(379): a, c, t, g, unknown or other
  misc_feature (379)..(379): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttacacaaatatggtatgaattgggtgcgacacggcccccgganaagggcttggaggtggggtgggggtgggtcaggcggtcgtttggacggtaaggcacgagtatgaccgaccgaagataggaagggcaagngtcaacgacttaccgacgggaccacccccgaacgaaccacacgtactacatcgacaacgtgaacgacgacctaggaacgacggcgtaggaaccggaaccgaaccgggtacccggttacttaacgttacgttacggttacgaccggtaaacgtaaatttcggtttttaaccgttggttacggtaactttacccgggttaaactttaaagttttacggttaagttaaacggggtccttaccgttaaggttcgggtaacggtttcgggtaaccgttttcggggttaacccgggggg

SEQ ID NO: 339613 - DNA, 602 bp, Homo sapiens
  misc_feature: GZ8MTXP01CEMWS.17.10.A10.1.454.CMB.2.raw
  modified_base (396)..(396): a, c, t, g, unknown or other
  misc_feature (396)..(396): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaatatggtatgaagttgggtgcgacgacggcccccggagaagggtcttggagggtggggtgggggtggggtcgaggtcggtcgtttagggaacgggtaagggcgacgtaggtagtgacccgaccggaagagtggaaggacagngtcacgataccgacggaccaccccacgaacacacgtactacatcgacaacgtagacgagaccgtagagacgcgtaggacgaccgacggccgtactacgttacgtgtgtacgtagtaagttgttttctgttctagttacgttaactaagtttgattacgggtccttgttaagtcgggtacgttcgggtaacgttcggtaaccggggg

SEQ ID NO: 339614 - DNA, 686 bp, Homo sapiens
  misc_feature: GZ8MTXP01ECWI4.17.10.A10.1.454.CMB.2.raw
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggcagtgatatatcttanaanaaatntgtatgaagttggtncgacacggccccggagaaggctggaggtggggtgggggtgtcgaggtcggtgtttgggaacggtaaggcacgagtagtcgaccgaaccggaaagagtaggaacgggacaaggtcgttacgaaacggtaaccgttaaaccccgaaccgggaaccccaaccccccgaaacgaaaccacgtaacggtacctaacgagtacgaacctaacgtacggaacgacgcccgtaggaaacgcggaccgaggaaccggaccgacgggtccttacttagttacgtggtacgtacggtaaagttaacgtttcggttttaactacgtttacgtacgtttaccggttaaattaagttttcgaagttacggtcttacgttaaggttcgggtacgttacgggttaacgttttccggggtaaccggggg

SEQ ID NO: 339615 - DNA, 679 bp, Homo sapiens
  misc_feature: GZ8MTXP01BS1NN.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaagttgggtgcgacgacggcccccggaacgaagggtcttggaggtggggtgggggtggggtcaggcggtcgtttggacggtaaggcaacgagtagtgccgaaccggaagagtaggaaaggggcaaggcgtacaaacgtacttaacccgacgggacccaaccccccgaacgaaccacgacgtactaacatgaccaaacgtcggaacgacgccctaggaagacgcgtacggaaccggaacgaacccgggtcccgtaacgttactttaaccgtggtacgtaccgtaaggtaatttcggttttaacgttcgttacgtaaacgttcggttaaaccttaaagttttcgttaagttaacggggtccttacgttaagtcgggtaacgttcggggttaaccgtttccggggtaacccgggggg

SEQ ID NO: 339616 - DNA, 733 bp, Homo sapiens
  misc_feature: GZ8MTXP01DPJZB.17.10.A10.1.454.CMB.2.raw
  modified_base (208)..(208): a, c, t, g, unknown or other
  misc_feature (208)..(208): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcgccggcccccgganaggagtcaccatctcttcgctctaccggaaacccccctaatcgttggattcaattatgtgtcctagtaccagacaaccgtcccggatccaccgacccccaaactcctacaatatatagaagaataaagtaacgaccgtaacccgtacggtacgggtttcccctacggtaccgtatttccgtacgtacgggtaccctaacccgtaaaggtcccgttacgggaccctaaccggttccgttccgacccccgtaaccccggttgggacccttaaccgtccgtaaccccgcccgtacccgttacccgaacggtaccgggtacgggggaacgtacgggtaccgtaacgtttaacgtttcgacggtaccgacgaaacgtcgttacgggtactttacccgacgtccgttaggtaccgtttcgggtggggttcggttcgggacgttacgggttacggaaccttaacggttccgttacggtaacccgtcggttaacggccgaccggacccgtaacggttcccgttaacccccggg

SEQ ID NO: 339617 - DNA, 792 bp, Homo sapiens
  misc_feature: GZ8MTXP01EQ9VU.17.10.A10.1.454.CMB.2.raw
  modified_base (303)..(303): a, c, t, g, unknown or other
  misc_feature (303)..(303): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaaggcagtgatatatcttacaactaaatagtggtatgaagttgggtagcgacgacggccccggagaacgggtnttggagggtggggtgggggtggtcgaggtcggtgtttagggaacgggtaaggcgaacgtaaggtactcggaccccgaaccggtaaaggagtaggggaaacggggaccaaggtaacggtaccgtaaaccggtaaccgtttaaaccccggaacccgggaaacccccaaaccccccgaaacggaaaacctaacccgtaaacggtttacccaaaaccgtacgttacgggaaacccctaaacggttacgggaaacccgtaccgggaccccgttagggaaacgggttacggacccggttaacggaaacccgggaaccggtacccggggttacccggttaccttaaaggtttacgtcgggtaacgtaccgtaaaggtttaactttcgttttcgtacgttactaacgtttaccgttaaattaacggttttgaacgttcgttccgtagttaacggtacgggtacgttcgggttaaccgttttcgggggaacccggggg

SEQ ID NO: 339618 - DNA, 709 bp, Homo sapiens
  misc_feature: GZ8MTXP01EGHKB.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcgaagccagtgatatatcttcaacaaaatatggtaatgaattgggtgcgaacgacgggcccccggaagaagggtcttaggaggtggggtgggggtgggtcgaggcggtcgtttggaacggtaaggcaacgagtaagtcggacccaaccggaaagagtagggaaacggggacaaggaacgttaccgaaacggaacttaaccccgaaccgggaaccccaaacccccgaaacgtaaaccaacgtaggtaccctaaacagtacgtaacgaacgtacgaacgacgtaccgtacggacgacgacggtacggaaccggaaccggaccggtaccgtacgttacgttacgttacggtacggtacggtaagttaacgtttcgtttcgttacgttacgttacgttacgttaacgttaacgtttagttacgttacggtaacgttacgttaacgttacggtacggttacgggttaaccggttccgggtaaccgggg

SEQ ID NO: 339619 - DNA, 693 bp, Homo sapiens
  misc_feature: GZ8MTXP01DUMP1.17.10.A10.1.454.CMB.2.raw
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcgagaagccgtggggcatcagtgactgtctcctgcaaggccagtgatatatcttcaacaaatntggtatgaattgggngcgacacggcccccgagaaggcttggaggtggggtgggggtggtcgaggcgggtcgtttaggacggtaaggctaacgaggtatcggacccaaccggaagtagtaggaacgggacaaggtcgtcgaaaccgtaacttacccgaccggaacccacccccgtaacgaaaccacgtaacgttacaaactagttacggaacctaacgttacgaaccggacgacccgtaggaacggaccgacggttacgggaaccgacccggtaccggggtccgttacttaacgtttaccgaggttcggacgtaaagtttcgttttcgttttaacgtggttactacgttttacggtaaacttaagtttcggttacgttacgggtctttacgtaaggtacgggtaccgttacgggtaacgtttcgggaacccggggg

SEQ ID NO: 339620 - DNA, 654 bp, Homo sapiens
  misc_feature: GZ8MTXP01CTIEF.17.10.A10.1.454.CMB.2.raw
  modified_base (589)..(589): a, c, t, g, unknown or other
  misc_feature (589)..(589): n is a, c, g, or t
tcagcgtagactagcacgaccggtgctcgatttagcgtcgatctcaggggagctctgcttcagctgtgagcgcagaaggcaggactcgggacaatcttcatcatgacctgcctccctctcctcctcacccttctcattcactgcacgaggtcctgggcccagtctgtgttgacacacgccgccctcagtgtctcggccggccccggagaggagtcacatctctgctctacgaacccccatgtgatcatatgcgtctagtacagacaaccgtccggataccaccgaccccaaactcctacatatatagaaataataaagtacgaccgtacccgtacgacggggtttaccccctacggtaccgtacttcgtacgtacgggtaccctcgtaaacgttcctacgggtcctaaccgtcgtaccgccccgaacccgttgggacctaaccgtcccgaacccgccgtacccgtaccgaacgaccgggtacggggaacgacgggtcccgttaaagttgtttccgacggccgaacgaaccgtagtacgggtacttaccgagtcccgtggtacccgttgggtaagggttcgttcggacgngggtacggaacagttcgttaccggaacgttacgaacggtcacggcccttaacggccgttccccgg

SEQ ID NO: 339621 - DNA, 651 bp, Homo sapiens
  misc_feature: GZ8MTXP01DBJLI.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatataggtatggaattgggtgcgaacgacggcccccggacgaagggtcttggaggtggggtgggggtgggtcaggcgggtcgtttaggaacgggtaggcacgtagtatcgaccaccggtaagatggaaagggacaggcgtacaacggaacttaccgacgggacccacccccaacgaactacaggtactacatacgacaaccgtgacgagacctggagacgcgttacggaacgaaccgaccggtccgtacttacgttacgtagtcgtaccgtaagtaacgtttcgttttaacgtggttaccctaaggttacttaacgttaagtttaggttacttaacgggtaaccttacgttaaggttcggacgtttacgggtaacctttcggggttaacccggggg

SEQ ID NO: 339622 - DNA, 728 bp, Homo sapiens
  misc_feature: GZ8MTXP01C0JLL.17.10.A10.1.454.CMB.2.raw
  modified_base (410)..(410): a, c, t, g, unknown or other
  misc_feature (410)..(410): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtggatatatcttacacaaatatggtatgaagttgggtgcgaacgacgggcccccggaacgaagggtcgtttggaggttgggggtgggggtgggtcgaggcgggtcgttttagggaacggtaagggctaacgagtagtcggacccaaccggaaagagtaggaaggggacaaggngtacaacgtaactaacccgaaccgacccaacccccaacgaaacctacacggtacctaacgatcggaacctaaacgtcggaaccgagtacccgaggaacgtacggacggtaacggaacccgtaccgaaacggggtcccttacgtaaacgtttaaccgtgggttacggaccggttaaaggttaaagttttcggtttttcccgtaaggtttaccgttaacttacggtttaaacctaaagtttttcggaagttacgggttaacctttacgttaagttacgggtacgttaacggggttccgtttaacggggtaacccgggggg

SEQ ID NO: 339623 - DNA, 567 bp, Homo sapiens
  misc_feature: GZ8MTXP01EVNZM.17.10.A10.1.454.CMB.2.raw
  modified_base (375)..(375): a, c, t, g, unknown or other
  misc_feature (375)..(375): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacaggccccccggagaagggcttgaggtgggtgggggtgggtcaggcggtctttggacggtaagggcacgagtatgcccaccgaagagtgaaagggcagngtcacgattaccacggaccacccccaagaacacagtctacgntagacaactgacgagcctgagngcgtgaacgaccgacggccgttctacgttacgtgtgacgagtaagttggtttctggttcattccgtaataatttggnttacgggtntcgttaagtcgggtaccttgggtaaccgtttcggtccggggg

SEQ ID NO: 339624 - DNA, 625 bp, Homo sapiens
  misc_feature: GZ8MTXP01C1G5J.17.10.A10.1.454.CMB.2.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
tcagcgtagactagcacgaccggtgctcgatttagcgtcgatctcagtggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctcctgcaaggccagtgatatatctnacaaatntgtangaagttggtgcgacgacggccccggagagggtcttggaggtgggggtgggggtgggtcgaggcggtcgtttaggacgggtaaggcaacgtagtagtcgacgacggaagagtaggaaagggcaaggagtcgaacgtactaccgacgaccaccccgacgaacacgagtactacatacgacaacgtcgaacgacgccgtagacgaggcgtagaaccgacgaccggtcccgtacttaacgttacgtggtcgacgtaagttaagtttcgttttcgttggttaccttagtttaacgtaactttaaagttttggttaacgttcggtaccttaacgttaaggtcgggttacggttcggttaacgtttccggggg

SEQ ID NO: 339625 - DNA, 601 bp, Homo sapiens
  misc_feature: GZ8MTXP01AN24B.17.10.A10.1.454.CMB.2.raw
  modified_base (381)..(381): a, c, t, g, unknown or other
  misc_feature (381)..(381): n is a, c, g, or t
  modified_base (521)..(521): a, c, t, g, unknown or other
  misc_feature (521)..(521): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacgggcccccggagaagggcttggaggtggggtgggggtgggtcgaggcgggtcgtttggacgggtaaggcacgagtatgccaccggagagtggaaggggcaagngtcaacggtacttaccgacgggacccaacccccaacgaaacacacggtactacatagacaactcgaacgacgccgtagagagcgtacgaacggacaacgggcctacgtattaccgtagtcgtacgtagtaacttgtttcnggttctattccggtaattaattttgacgttacgggtcttacgtaagttcggacgttcgggtaaccgttttggccgggggg

SEQ ID NO: 339626 - DNA, 630 bp, Homo sapiens
  misc_feature: GZ8MTXP01B1R3F.17.10.A10.1.454.CMB.2.raw
  modified_base (420)..(420): a, c, t, g, unknown or other
  misc_feature (420)..(420): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacacgcccgccctcagtgtctcgccggcccccggacaggacggtcaccatctcttgctctacgaaaccccccaatgttggtattcaattatgtgtcctggtaccagccaactcccggatccaccgacccccaaactcctacatataactgaaagataaataacgccgtacctcgacggggttcccctgacgtcttctcgtacgctccgtaagtcgtcgggctaccgtctcgcccaccgtggactacnccgaccgcgcctccgagaccgtggggacgacggtccgtagttacgttcgtcgacgacgaacgtgtacgggtacttacccgcgtccgtaacggtcgtttccgggtggggttcgttaccgggcgttaacgggttacgggaccgttaaacggttccgttacggtaacccgttaccggtaacgtaccgacgacccgaacggttccgtccccggg

SEQ ID NO: 339627 - DNA, 690 bp, Homo sapiens
  misc_feature: GZ8MTXP01AZ7HE.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctctgcaggcagtgatatatcttacaacaaatatggtatgaattgggtgcgacgacggcccccggagaagggtcgttggagggttggggtgggggtcgggtcgaggcgggtcgtttaggacgggtaaggcacgtaggtatcgacgaccggaagagtaggaagggacagaagtacgacgtacgttacccgaccgggacccaacccccgaacgaaccgtaacacgtacctaactacgttacgaccgaaacgtcgaacgacgacccgtagaacggacgtacgtacgggaaccgacgtaacccgggtccggttaccttagtttacgtcgggtacgtaccggtagtaaacgtttggttttaaccgttcggttacgttaacggttacgttaaacctaaggtttttacgagttacgggtaacttccggtaattcgggtacggttacgggttccgtttcggggttaacccgggggg

SEQ ID NO: 339628 - DNA, 619 bp, Homo sapiens
  misc_feature: GZ8MTXP01AFF3D.17.10.A10.1.454.CMB.2.raw
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (532)..(532): a, c, t, g, unknown or other
  misc_feature (532)..(532): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaactaaaatntggtatagaagttgggtgcgacgacggcccccggagacgggcttggagggtggggtgggggtggtcaggcggtctttggacggtaagcagagtatgaccacgtagngtacggaaggcaggcgtacgacgtactaccgaccggaccaacccccgaagaaccaacgacgtacaacagtcgaaccaactcggaacgtacgcctaggacgagcgtaggaccgaccgaaccgggtccttacgtattaccgtggtagtcggtaatactttggtttcncggttacagttccgttaaataagttttgagttacggtcttacgtaaggttagggtaccgttacgggtcgtttaacggggtccggggg

SEQ ID NO: 339629 - DNA, 608 bp, Homo sapiens
  misc_feature: GZ8MTXP01ANOHG.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttacaacaaaatatggtatgaattgggtgcgacacggcccccggagaagggcttggaggtggggtgggggtgggtcgagtcggtcgtttggacggtaaggcacgagtatcgccaccggaagagtaggaaagggcaggaagtacgaacgattacccgaacgggacccaacccccgaacgaaacctacgaggtacctaacgaactcgaacaacgtgaacgacgcctagagagccgtgaaccgacacgggtcctcgtagttacgtgtcgacgtagtaatttgtttctggttctagttcgtaactaagttttagattacgggtccttagtgtagggtaaccgttggtaaccgttcgggtaaccggggg

SEQ ID NO: 339630 - DNA, 706 bp, Homo sapiens
  misc_feature: GZ8MTXP01C44ZZ.17.10.A10.1.454.CMB.2.raw
  modified_base (249)..(249): a, c, t, g, unknown or other
  misc_feature (249)..(249): n is a, c, g, or t
  modified_base (393)..(393): a, c, t, g, unknown or other
  misc_feature (393)..(393): n is a, c, g, or t
tcagcgtagactagcacgaccggtgctcgatttagcgtcgatctcaggggacccaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgacaaggcagtgatatatctanaactaaatagtaggtatgaagttgggtgcgacgacgggacccccggagaagggtcgttaggaggggttgggggtgggggtcggggtcgaggtccgggtcgttttagggaacgggtaaggcacgagtatcggacccacggaaagngtaggaagggaacgaagcgtacgaaccgtaaacgttaccccgaaccgggaaccccaaaccccccgaaacggtaaaccaacgacgtacctaacactacggaccaaacgtagaaccggcgaccgtaggaacgacgtacggtacggaaccggtaaccgaaccggggttcccgttacttaacgttaccgtaggttccggacgttaaggtaactttggttttccgtgttacgttacttaacggttaaacttaagtttagttagttaggtaaccttagtaagttcggacgttcggtaaccggtttcgggtaaccggggg

SEQ ID NO: 339631 - DNA, 601 bp, Homo sapiens
  misc_feature: GZ8MTXP01CLM3W.17.10.A10.1.454.CMB.2.raw
  modified_base (440)..(440): a, c, t, g, unknown or other
  misc_feature (440)..(440): n is a, c, g, or t
  modified_base (541)..(541): a, c, t, g, unknown or other
  misc_feature (541)..(541): n is a, c, g, or t
tcagcgtagactagcacgaccggtgctcgatttagcgtcgatctcaggggagctctgcttcagctgtgagcgcagaaggcaggactcgggacaatcttcatcatgacctgcctcccctctcctcctcacccttctcattcactgcacagggtcctgggcccagtctgtgttgacacacgccgccctcagtgtcgtcgcccggcccccggacgaggacgtcaccatctctgctctacgaacccccatgtgattcattatgtcgtcccggtacacgaccaaccgtcccggactccgaccgacccccaaactcctacatatactagaagtaataaactaacgccgtaccctagtacgggttacctcgtacctacttcgtcgtacggtacctaccaagtcgtcggacctacgtctcgaccctaccgtggccacgtccgaccgcnccgtacgagtacggtaggggaccgacggaccgtagttactttcggcgacgtacgaaacctggtacggacttccgacgtcgtagtcgtggtgggtcttcggngtacggagaacccagttcgttcggaccgtgacggtcacgccgacgtccgttccgtccccg

SEQ ID NO: 339632 - DNA, 674 bp, Homo sapiens
  misc_feature: GZ8MTXP01BF9FN.17.10.A10.1.454.CMB.2.raw
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (582)..(582): a, c, t, g, unknown or other
  misc_feature (582)..(582): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtgatatatcttcaanaaatataggtatgaattgggtgcgacgacggcccccgganaagggtctaggaggtggggtgggggtggtcgaggtcgggtctttggaacgggtaaggcacgaggtatcgacccgaaccggaagagtaggaaagggacaaggaagtcgaacgtacttaaccccgaaccggaacccaaaccccccgtaacgaaaccacgtaacgtacctaacaagttacgaaccaaaccgtagaaccggacgtacccgtaggaagacgcggtacgaaccggaccgtaaccgggccgttactacgttacctgggtcgtaccggtaagtaactttgttttccgnggttactatttaccggtaaattaagttttaggagttacggtcttacgtaagttcgggtacgttacgggtaaccgtttcggggtaaccggggg

SEQ ID NO: 339633 - DNA, 746 bp, Homo sapiens
  misc_feature: GZ8MTXP01BT77X.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaagttgggtgcgacacggcccccggagaagggtctggaggtggggtgggggtgggtcgaggtcgggtcgttttagggaacgggttaaggcaacgtaggtatggacccaaccggaaagagtaggaaggggacaaggaagtacaacggtacttaaccccgaaccgggaacccaaccccccgaaacggaaaccaaccgtaacggtacctaacgaacgttacggaacctaaacgtacggaaccggaacgaccccgtaggaaacgggtacggaccggttaacgggaaacccggaaacccgtaacccgggggtacccggttaaccttaacgtttaaaccgttgggtacggtaaccggtaaagttaaagttttcggtttttaaccgtcggttacgtaaacgtttaccggtaaccttaagttttaggacgttagggtaaccttacgtaagttcgggtacgttagggtaaccgtttcgggtaacccggggg

SEQ ID NO: 339634 - DNA, 608 bp, Homo sapiens
  misc_feature: GZ8MTXP01EQRBM.17.10.A10.1.454.CMB.2.raw
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (562)..(562): a, c, t, g, unknown or other
  misc_feature (562)..(562): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggcagtgatatatctananaaatntgtatgaatgggtgcgacacggccccggagagggctggaggtgggtgggggtgggtcaggcgggtctttagggacggttaaggcacgagtatggacccacggaaagagtaggaagggacaaggcgttacaacggacttacccgaacgggaaccccaacccccgaacgaaaccacgtacgtactacatcgacaacgtgacgacgccgtagacgacgcggcgaaccgaccgacggggtaccttacttacgttacgtggttcgaccgtaaggtaatttcgtttctgttacctagttacctaagttattagnttacggtctgtaagtggtacgttcgggtaacgttcggtaacggggg

SEQ ID NO: 339635 - DNA, 670 bp, Homo sapiens
  misc_feature: GZ8MTXP01EVZJ3.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggcagtggatatatcttcaacaaattagtggtatgaagttgggtgcgacgacgggccccggagaagggtcgtggagggtggggtgggggtggtcgaggtcggtcgtttacgggacgggtaaggcacgtagtagtcgaccgaccggaaagagtaggaacgggacagcgtacaacgtactacccgaccggacccacccccgaacgaacacacgtctacagtgacacgtagacgacgccgtaggagaacgcggtacggaccggaccgtaccgggtccgttaacttacgttacgtggtacgtacggtaattaacgtttcgttttcgtaggttctaacgtttacgttaaacgtttaagtttacggttacgttacggggtaactttaccggtaaggttagggtacccggttacgggttaacccggtttcggggtaacccggggggg

SEQ ID NO: 339636 - DNA, 620 bp, Homo sapiens
  misc_feature: GZ8MTXP01AEKEF.17.10.A10.1.454.CMB.2.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttacaacaaatagtggtatgaagttgggtgcgacgacggcccccgganaagggcttggaggttgggggtgggggtggtcgaggcggtagtttggacggtaggcacgtagtagtcgacccgaaccgaagagtaggaagggacaaggtaacgtacaacggtacttaacccgaaccgggaaccaacccccgtaaagaaccacacgtcacatgacaactgacgacgccgtagacgacgcgacgacggaccacggtcgtctagttacgtggcgtacgtagtactttggtttctcggttacacgttaccgttaacttaagtttgaacgttcggaacttccgtaagttacggtacgttacggtaacgttcgggtaaccggggg

SEQ ID NO: 339637 - DNA, 563 bp, Homo sapiens
  misc_feature: GZ8MTXP01C4GER.17.10.A10.1.454.CMB.2.raw
  modified_base (251)..(251): a, c, t, g, unknown or other
  misc_feature (251)..(251): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (506)..(506): a, c, t, g, unknown or other
  misc_feature (506)..(506): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttanacaaaatatggtatgaattgggtgcgacaggcccccggacaagggcttgaggtgggtggggtggggtcaggcggctttggacggtaaggcacagtatcgcaaccggaagagtagaacgggacagaagtcaacgtattaaccgacggacaccccaagaacacagtacaanatacgactaacngacgagccagagagacgtgaccgacacgggccgtctattaccgtagtcgagtagtaattggttttctgttactnttacgtactaattttagagttaggcctatgtcggacttgggtaacttcggtcggggg

SEQ ID NO: 339638 - DNA, 632 bp, Homo sapiens
  misc_feature: GZ8MTXP01DAHJV.17.10.A10.1.454.CMB.2.raw
  modified_base (381)..(381): a, c, t, g, unknown or other
  misc_feature (381)..(381): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaatatggtatgaattgggtgcgacacggcccccggagaagggcttggaggtggggtgggggtgggtcgaggcggcgtttagggacggtaaggcacgagtatcgccgaccgaagagtaggaagggcagngacacgaattacccgacgggaccacccccgacgaacacacggtctacattgacaactggacgacgcctagaagacgcgtacggacgaaccgacgggcccgttactacgttacgtgtcgtacggtaagtaatttggtttttcctgttaccgtaagttaccgttaaacgttaagttttacgttatttaacggggtcttaccgttaagttacggggtacgttcggggttaaccgtttcggggtaacccgggggg

SEQ ID NO: 339639 - DNA, 676 bp, Homo sapiens
  misc_feature: GZ8MTXP01D9F9W.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaatataggtatggaagttgggtgcgaacgacggcccccggagaagggtcttggagggtggggtgggggtgggtcgaggtcggtgttttagggaacgggtaaggcacgagtatcggaccccaccggaaagagtaggaaggggaccaaggcgtacaaccggtaaacttaaccccgaacccgggaacccaacccccccgaaacggaaaccacgtaacgtacctacagtacgacaacgtggaacgagccgtaggacgacgacggtacggaaccggaaccgtaacccggtccgtacttaacgttaccgtgtaggtcgtaagtaatttcgtttaactgttacctatttacgtaaagttaatttggagtttacggctttacgtaaggttcgggtacgttacgggttaacgtttaacgggccgggggg

SEQ ID NO: 339640 - DNA, 693 bp, Homo sapiens
  misc_feature: GZ8MTXP01DSEXN.17.10.A10.1.454.CMB.2.raw
  modified_base (247)..(247): a, c, t, g, unknown or other
  misc_feature (247)..(247): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtggggcatcagtgactgtctcctgcaaggccagtggatatatcttnactaaatatggtatgaattggggtgcgacgacggcccccggagaagggcttggagggtggggtgggggtggtcgaggcggtctttggacggtaggcacgtagtatcgaccaccggtaaagcgtaggaaggggaccaaggtaacggtcaaacgggtaatttaacccgaccggggaaccaacccccccgaagaaacccaacgaacggtacctaacagttacggactaaaccgtaggaaccggacgccgtaggaacggacgacggttacggaaccggaaccgtaccgggtacccgttaccgttacttacccgttagggtcgaccggtaaggttaaatttcgggttttaacctggttactacgttaccggttaacttaagtttagttagttaacgggtccttaattaacgttacgggacttacggggtaactttccgggtaaccgggggg

SEQ ID NO: 339641 - DNA, 619 bp, Homo sapiens
  misc_feature: GZ8MTXP01EI69V.17.10.A10.1.454.CMB.2.raw
  modified_base (249)..(249): a, c, t, g, unknown or other
  misc_feature (249)..(249): n is a, c, g, or t
  modified_base (439)..(439): a, c, t, g, unknown or other
  misc_feature (439)..(439): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttanacaaatatggtatgaagttgggtgcgacgcggacccccggagaagggtctggagggtggggtgggggtgggtcgaggtcggtcgtttagggaacgggtaaggccagtaggtatcgaccgaaccggaagagtagggaaggacagcgtcaacgtactaccgacgacccaccccaagaccacacgtactacanacgacaactacggacgacgccgtaggagacgcgtagaaccgacgacggtccgtctacttcgtagtgtacggtaagttacgtttcgttttctacggttacctagtttaccgtaactttaagttgttagttacggtcttacgtaaggtcggtacgttacggttcggttcgggtaaccggggg

SEQ ID NO: 339642 - DNA, 598 bp, Homo sapiens
  misc_feature: GZ8MTXP01DB5OH.17.10.A10.1.454.CMB.2.raw
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtggggcatcagtgactgtctcctgcaaggccagtggatatatcttacaacaaaatatggtatgaattgggtgcgacacggcccccggagaagggcttggaggtgggtgggggtgggtcgaggcggtcgtttggacggtaagggcacgagtatcgaccaccggaagagtaggaagggcagngtcacgaattacccgacgggaccacccccgaacgaacanacgtactacatagacaacgtagacgagccgtgaagagcgtacggaccggaacgaccgggccgttactagttaccgtgtgacgagtaacttggttttctgttctattcgttaactaagtttgttagttacggtccttgttaagtgggtaccttgggtaaccgttcggtaaccgggggg

SEQ ID NO: 339643 - DNA, 611 bp, Homo sapiens
  misc_feature: GZ8MTXP01ESY4N.17.10.A10.1.454.CMB.2.raw
  modified_base (469)..(469): a, c, t, g, unknown or other
  misc_feature (469)..(469): n is a, c, g, or t
  modified_base (560)..(560): a, c, t, g, unknown or other
  misc_feature (560)..(560): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctgggggcatcagtgacttgtctcctgcaaggccagtggatatatcttacacaaaatatggtatgaattgggtgcgacaggcccccgagaaggctggaggtgggtgggggtgggtcaggcggtcgtttggacggtaaggcacgaggtatcgaccaaccggaaagagtaggaaaggggactaaggcgtacaaacgtattaacccgaaccgggaaccaccccccgaagaacccaacagtactacaatgacaacgtgacgagcctgaagngcgtcggaacgaccgaacgggcctactagttacctaggtcgagtaagtaagtttggtttctggttcctaagttcgtaaactaattttaggnttacgggtccttgttaagtcggtacgttcggtaacgtttcggtccgggggg

SEQ ID NO: 339644 - DNA, 675 bp, Homo sapiens
  misc_feature: GZ8MTXP01EUQ3F.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaagttgggtgcgacagtcggccccccggaagaagggcgttggaggttgggggtcgggggtgggtcgaggtcggtcgtttggacgggtaggcacgagtatcgacgaacgaagagtaggaaaagggcaaggagtacaacgtactaaccgacgggaccaacccccacgaacacagtctaacgatacgactaacgtgaacgacgcctaggagacggacgtacggaaaccggaccaacgacgtcccgttacttaaacgtttccgtggtacggtaccggtaagttaaagttttcggttttttccgtaggtttaccctaagtttacccggtttaaacgttaaacgtttttacggtaagttaagggttccctttacggttaaggttacggggttaaccgtttcggggtttaacccggg

SEQ ID NO: 339645 - DNA, 561 bp, Homo sapiens
  misc_feature: GZ8MTXP01ATKUD.17.10.A10.1.454.CMB.2.raw
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (426)..(426): a, c, t, g, unknown or other
  misc_feature (426)..(426): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattggggtgcgacacggcccccgganaagggcttgaggtggggtggggtggtcagcggtntttggacggtaaggcacagtactgcccaccggaagatggaagggcaggcgtcgaacggacttacccacgggacaacccccagaacacagtctacatgacaacngacgaagcctgagacgcgagacgacacggccgtctattactgtgcgtaagtaattgtttctgttcattcgtaactaatttagagttaggtctccgtaagtcggtacgttcggtaacgttttcccggtaagggggg

SEQ ID NO: 339646 - DNA, 751 bp, Homo sapiens
  misc_feature: GZ8MTXP01CYE4A.17.10.A10.1.454.CMB.2.raw
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccaggtggatatatcttanaacaaaatntaggtatgaagttgggtgacgacgacgggcccccggaagaagggtcgttggaggtggggtgggggtaggtcgagggcggtcgtttaggaacgggtaaggcaacgtagtatcggaccaaccggaagtagtaggaaaggggaccagggtaacgttaccgaaacggtaaacgtttacccgaaccgggaacccaaaccccccgaaggtaaacccaacgtaggttacctaacgacgttacgaccgttaaacgtagggaaccggaacgcccgttaggaacggtaacgcggggttacgaaacccggtaacggaacccggggtccctttaaggtactttaccggtaggtccggtaacggttaagttaaacgtttcgttttaaccgtggttacctaacgtttaccgggtaaactaaaggtttttgaaacggttcggggtaaccctttacgttaaggtcccggtaaaggttcgggttaaccgttcgggtaacccgggggg

SEQ ID NO: 339647 - DNA, 741 bp, Homo sapiens
  misc_feature: GZ8MTXP01DADCW.17.10.A10.1.454.CMB.2.raw
  modified_base (320)..(320): a, c, t, g, unknown or other
  misc_feature (320)..(320): n is a, c, g, or t
tcagcgtagactagcacgaccggtgctcgatttagcgtcgatctcaggggagctctgcttcagctgtgagcgcagaaggcaggactcgggacaatcttcatcatgacctgcctcccctctcctcctcacccttctcattcactgcacagggtcctgggcccagtctgtgttgacacacgcccgccctcagtcgtcgtcggccggcccccggagaggacgtcaccatctctgctctaccggaaacccccatgtgattctaattatgtcgtcctaggtaccagaccaaccgtcccggataccaccgacccccaaactcctanaatactatagtaaagaataaacgtacgaccgacccgtcgacggggttccccacgtacgtacttcgtcgtacggtctaaccgtaagtcgtacggtccgtaccgttccgtccgaccccgtaccccgttcgggacctaccgtacccgaccccggccgtacccgttacccggaacgggtaaccgggtacgggggacccgaaccggggaccgttaacgggtttacttttccggtacggaccggaaccaaacgtacggttaccgggtacctttaacccggacgttccccgtacggttccgttcgggggtttcggggttcggtttccggggacgttacgggttaccgggaaccttaacggttcgttacccgggtaaccccgtacgtaacggaccgaccggttacccgtaacggccccgttaaccccgg

SEQ ID NO: 339648 - DNA, 608 bp, Homo sapiens
  misc_feature: GZ8MTXP01CTZ2Q.17.10.A10.1.454.CMB.2.raw
  modified_base (539)..(539): a, c, t, g, unknown or other
  misc_feature (539)..(539): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttacaacaaatatggtatgaattgggtgcgacacgggcccccggagaagggcttggaggtggggtgggggtggtcgaggcgggtctttgggacggtaaggcacgaggtatcggacccaccggaagacgtagggaaagggccaaggaacgtcaacgtacttaaccccgaccgggaaccccaacccccgaacgaaaccacgaacggtactacgacgtcgacaactacgacgacgccgtagagagcgtagacgacgacggccttactattcgtaggtcgtcgaagttattgttttcngttctagttccgttaaatagtttagagttaggtctgtaagttggtcttagggtccgtttcggtccgggg

SEQ ID NO: 339649 - DNA, 685 bp, Homo sapiens
  misc_feature: GZ8MTXP01D5V7V.17.10.A10.1.454.CMB.2.raw
  modified_base (272)..(272): a, c, t, g, unknown or other
  misc_feature (272)..(272): n is a, c, g, or t
  modified_base (383)..(383): a, c, t, g, unknown or other
  misc_feature (383)..(383): n is a, c, g, or t
  modified_base (627)..(627): a, c, t, g, unknown or other
  misc_feature (627)..(627): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaatatggtatgaattgggngcgacacggccccgagaaggtctgaggtggggtgggggtggtcgaggcggtcgtttaggacgggtaaggcacgagtagtcgacccgaccggaaagagtaggaagggacagngtacgaacgtacttaacccgacgggaacccacccccgaacgaaccacacggtactaacagtacgaccaacgtacgaacgacgacccgtaggaacgacgaccggtacggaaccgaaccgacccgggtacccgttacgttaacgttacgttacgggtacgtaccggttaacgttaagttttcgttttaaccgtggttactaacgtttaccggttaaacttaagttttacgttaaggttaacggttnttaccggttaagttacggggtaacgttcgggtaacccgttcggggttaacccgggggg

SEQ ID NO: 339650 - DNA, 661 bp, Homo sapiens
  misc_feature: GZ8MTXP01D8WPN.17.10.A10.1.454.CMB.2.raw
  modified_base (251)..(251): a, c, t, g, unknown or other
  misc_feature (251)..(251): n is a, c, g, or t
  modified_base (624)..(624): a, c, t, g, unknown or other
  misc_feature (624)..(624): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaagcagtgatatatcttacanaaatatggtatgaatgggtgcgacgacggccccggagaaggtcttggaggtgggtgggggtggtcaggtcggtgtttaggaaggtaaggcaacgagtagtcgacccgaaccggaaagagtaggaaaggggaccaagtaacggtacctaaacgggaactttaaaccccgaaccggggaaccccaaacccccccgtaaacggaaacccaccgtaaacggttaccctaaacggaacttacggaacctaaaccgtagaaccggaacgacccgtagaacgacgcggtacggaacgaccgaccggtccgtacttaacgttacgtaggtgtaccggtagtaacgtttcgtttaactgttactacttacgtaataatttgnttaggtccttataagtgagttcgtcgttggtcggggg

SEQ ID NO: 339651 - DNA, 660 bp, Homo sapiens
  misc_feature: GZ8MTXP01DU5O1.17.10.A10.1.454.CMB.2.raw
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaatntggtatgaattgggtgcgacgacgggcccccggaagaagggctttggagggtggggtgggggtgggtcgaggtcgggtcgtttagggacgggtaaggcacgagtagtcgacccgaccggaaagagtaggaacgggacaggtaacgtcgaacgtaacttacccgaacggacccacccccgaacgaacactacgtacacatcgaccaacgtgacgagccgtagagtacgcgtacggacgacgaccggtccgtatacgtttacgaggtcgtacgtaagttaactttggttttaacctaggttacctaagttttacccggtaaactttaagttttcggaagttacgggtccttacgttaaggtcggggtacgttacgggttaaccgttttcggggtaaccgggggg

SEQ ID NO: 339652 - DNA, 597 bp, Homo sapiens
  misc_feature: GZ8MTXP01EYAYM.17.10.A10.1.454.CMB.2.raw
  modified_base (429)..(429): a, c, t, g, unknown or other
  misc_feature (429)..(429): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttacaacaaaatatggtatgaattgggtccgacgacggccccggagaagggcttggaggtgggggtggggtgggtcgaggcggtcgtttggacggtaaggcacgagtatgcaacccggaagagtggaagggcaagacgtcgacgtaactacccgacggacccaccccgacgaacacagtctacngtagcaactgacgagtccgagagagtctagggacgtacgaccggccgtacgttattacgggtgtacggacgtagtaattgttttcctgttaccttagttaccgttataagtttgagttcggttctaagtagttcggactcgggttacgttccggttggggaacccggg

SEQ ID NO: 339653 - DNA, 638 bp, Homo sapiens
  misc_feature: GZ8MTXP01DLEAW.17.10.A10.1.454.CMB.2.raw
  modified_base (383)..(383): a, c, t, g, unknown or other
  misc_feature (383)..(383): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaatatggtatgaattgggtgcgacaggcccccggacgaagggcttggaggtggggtgggggtgggtcgaggcgggtcgtttggacgggtaaggcacgagtatgaccaccggaagataggaaggggcaaggngtcaacggaacttacccgaccggaccacccccgaacgaacacacgtcacatagacaacgtcgaacgagcccgtgaaggacgcggtacggaaccggaaccgaccgggtcccggttactactttaacgtcggtgtaccggtaagtaactttggtttttctggttacctagttacgttaaacgtaagttttaggagttaacgggtctttacctaagttgggaccgtttacgggtaaccgttttcgggtaaccgggggg

SEQ ID NO: 339654 - DNA, 554 bp, Homo sapiens
  misc_feature: GZ8MTXP01DHCO5.17.10.A10.1.454.CMB.2.raw
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacacaaatatggtatgaattgggtgcgacgaggcccccggagaagggctggaggtgggtggggtgggtcagcggctttggacggtaggcacagtatgcaccggaagngtaggaaggcagngtcacgattaccgacggacacccccagaacacagtctacatgacaactgacgagcctggagagcgtacgacgaacagggtcctctattactggtgacgtaggaatttgttttctgttcgtattcgttaaataagttttagattacggtctacgtaagtgggacttagggtaacttcggtccggggg

SEQ ID NO: 339655 - DNA, 774 bp, Homo sapiens
  misc_feature: GZ8MTXP01EG4KS.17.10.A10.1.454.CMB.2.raw
  modified_base (248)..(248): a, c, t, g, unknown or other
  misc_feature (248)..(248): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggcagtgatatatcttanaacaaatatggtatagaagttgggtgcgaacgacgggcccccggagaagggtcttggagggtgggggtgggggtgggtcgaggtcgggtcgtttgggaacgggtaagggcaactaggtatcgaccgaccggaaagagtaggaaacgggacgaaggaacggtacaaacggacgtttaaccccgaaccggggaaccccaaaccccccgaaacggaaaccaaccgtaacggtaccttaaacaacgttacgaaccgtaaaccttcggaaaccggaacggacccgttagggaaacggtacgggaacccggttaggaaacccgggaacccgtaacccgggggtaccctttaccggttaactttaaccgtcgggttaggtaccgggtaagttaaacgttttcgttttaaccgttggttacctaagtttacccggttaaacttaaagttttaggttagttacgggttaacccttacgttaacggttggggtaaccgttacggggttaaccccgtttgggttaaccccggggggg

SEQ ID NO: 339656 - DNA, 676 bp, Homo sapiens
  misc_feature: GZ8MTXP01A39EZ.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaactaaatatggtatgaagttgggtgcgacgacgggcccccggagaagggtcttggagggttgggggtgggggtgggtcgaggcgggtcgttttagggaacgggtaaggcacgtagtagtcgacccgaaccggaaagagtaggaaaggggactaaggaacgtaccgaaacggtaacttaaccccggaaccgggaaccccaaaccccccgaaacggaaaccaacgtacgtacctaacacgttacgaccgaacgtacgacgacgccgtaggaacgacgcggtacgaaccgaccgaccgggtccgtacttagttacgtggtacgacgtaagtatttcggtttctgttactacgttacgtaacttaagtttgacgttacggtcttacgtaagttcggtacgttcggtaacgtttcgggtaaccggggg

SEQ ID NO: 339657 - DNA, 573 bp, Homo sapiens
  misc_feature: GZ8MTXP01BSMC2.17.10.A10.1.454.CMB.2.raw
  modified_base (291)..(291): a, c, t, g, unknown or other
  misc_feature (291)..(291): n is a, c, g, or t
  modified_base (379)..(379): a, c, t, g, unknown or other
  misc_feature (379)..(379): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgacggcccccgganaagggcttggaggtggggtgggggtgggtcaggcggtcgtttggacggtaggcacgagtatgccaccggaagagtaggaagggcaggngtcacgattaccgacggacacccccagaacacacgtctacatcgacaactgacgagcctagagacgcgtaggaccgacgaccgggtccgtctagttacgtgtgtcgtagtattggtttctggttcctagttcgtaactatttgattacggtctacgttaagtggtacgttcggtaacgtttcggtaaccggggg

SEQ ID NO: 339658 - DNA, 631 bp, Homo sapiens
  misc_feature: GZ8MTXP01C0DFT.17.10.A10.1.454.CMB.2.raw
  modified_base (386)..(386): a, c, t, g, unknown or other
  misc_feature (386)..(386): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgacggcccccggagaagggctttggaggtggggtgggggtggggtcgaggcggcgtttggacggtaaggcacgagtatgacccaaccggaagagtaggaagggacaagngtcaacggacttacccgacggacccaaccccgacgaacacacgtactacatcgacacgtgaacgacgccgtagacgagcgtacggaaccggaccgaccgggtccgttactaactttaccgtgtcggtacggtaagtaacgtttgttttccgtggttcttaacgttaccggttaaactaagttttagagttacgggtcttacgttaagtacggtacgttagggtaaccgtttcgggtaaccggggg

SEQ ID NO: 339659 - DNA, 702 bp, Homo sapiens
  misc_feature: GZ8MTXP01B0J2E.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgcctccctctcctcctcacccttctcattcactgcacacgggtcctgggcccagtctgtgttgacacacgcccgccctcagtcgtcgtcgccgggcccccgagaggacgtcacctatctctcgctccgtaccggaaaccccctatgttgattctaattatgtgtctggtaccagaccaacgtcccggataccaccgaccccctaaactcctactaagttaactagtagaaagtaaactaaagtaacgaccgtaccccgtacggtaccggggtttacccctacggaccgtacgttcctccggtacggtaccctcccgtaaaggttccgtacggacccgtaccggtccgtccgaccccgtaccgtcgggacctaccgtccgacccgaccgtacgtaccgacggacgggtcggggacgacggtacgtacgttacgtttcgacggtaccgacgaaacgtggtacggtacttacccgacgtccgttacgtacgttggggtcgggttcggttcgggacgttacggtacgggaaccgacggttccgttcggtaaccctccgtaacggtaccgacggacccgtaacggttcccgttccccg

SEQ ID NO: 339660 - DNA, 631 bp, Homo sapiens
  misc_feature: GZ8MTXP01EZY57.17.10.A10.1.454.CMB.2.raw
  modified_base (189)..(189): a, c, t, g, unknown or other
  misc_feature (189)..(189): n is a, c, g, or t
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctnaggtgcagaagcctgggcatcagtgactgtctcctgcaaggccagtggatatatcttcaacaaatntaggtatgaattgggtgcgacgacgggcccccggagagggtcttggaggtgggtgggggtggtcagcggtcgttaggtacggtaaggctacgagtagtcgacccaccggaagagtaggaacggggacaaggtaacgtaccaacggtacttaccccgaacgggaccccaacccccgaaacgaaccaaccaggtacctacatacgacaacctgaccgaaggccctgagagcgcgacggacacggccggtcctattacctagtgtccgtaggtaaatggttttcctggttcctaattacggttaaaccgtaacgtttacggttacttaagggtacgttaaccgtaacgttgggttaccgttcgggttaaccgggttccg

SEQ ID NO: 339661 - DNA, 616 bp, Homo sapiens
  misc_feature: GZ8MTXP01BCVP5.17.10.A10.1.454.CMB.2.raw
  modified_base (397)..(397): a, c, t, g, unknown or other
  misc_feature (397)..(397): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatatggtatgaagttgggtgcgacacgggccccccggacgaagggtctttggaggttggggtgggggtgggtcgaggcgggtcgtttggaacggtaaggcacgagtatcgaccaaccggaaagagtaggaaaggggcaaggngtcaaaccggattacccgaacggacccacccccaacgaaccaactagtacctaacgattacgaccaactgaacgacgtcctagacgacgcgtacggaacgaccgacggtccgtctagttacgtgtgacgtagtaattgtttaactgttcagttccgtaattagtttgagttaggtcttcgtaagtcggtacttcgggtaaccgtttcgggtaacggggg

SEQ ID NO: 339662 - DNA, 557 bp, Homo sapiens
  misc_feature: GZ8MTXP01A515Z.17.10.A10.1.454.CMB.2.raw
  modified_base (290)..(290): a, c, t, g, unknown or other
  misc_feature (290)..(290): n is a, c, g, or t
  modified_base (377)..(377): a, c, t, g, unknown or other
  misc_feature (377)..(377): n is a, c, g, or t
  modified_base (496)..(496): a, c, t, g, unknown or other
  misc_feature (496)..(496): n is a, c, g, or t
  modified_base (528)..(528): a, c, t, g, unknown or other
  misc_feature (528)..(528): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggccccccgganaagggctttggaggtggggtgggggtggggtcgaggcggtctttggacggtaaggcacagtatgccaccggaagagtgaagggcagngtcacgataccacggacacccccagaacacagtctacatgacaaacgtgacgagccctgagacgtcgaggaccgacgaccggtccgtactacttacgtgtcgcgaagtaagttgtttcngttaccattcgtaactaatttgattaggtctntaagtggaccttggtaactttggcggggg

SEQ ID NO: 339663 - DNA, 652 bp, Homo sapiens
  misc_feature: GZ8MTXP01DSQ8K.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaagccagtgatatatcttacaactaaatatggtatggaattgggtgcgacgacggcccccggagaagggcttggaggtggggtgggggtgggtcaggcggtcgtttggaacgggtaaggcacgagtagtcgccgaaccgaagacgtaggaacgggtacaaggcgtaccgaacgtaaacttaaccccgaccggaacccacccccgaaacgaacccacgtacgtactaacatacgaacaacgtacgaaccggacgaccgtagacgacgacgtacggaacgaccgacggtacccgtacttagttaccgtggtacgtacgtaagtaacgtttgtttaacgtgttacttacgttacggttaactaagtttacgttacgttaggtcttacgtaagttccggagtttcggtaaccgttcgggtaacggggg

SEQ ID NO: 339664 - DNA, 616 bp, Homo sapiens
  misc_feature: GZ8MTXP01B4CZQ.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgcaaggccagtgatatatcttacacaaaatntggtatgaagttgggtgcgacgacgggacccccggagaacgggtcttggagggtggggtgggggtggtacgaggtcgggtcgtttgggaacggtaaggcaacgagtagtcgaccaaccggaagagtaggaagggcagaagtacacgtattaacccgaccggaaccaccccccgaacgaacacgacgtactacatcgacaactgaacgagcctgacgagcgtacggaccgacacggtccgtacttacgttacgtggtgacgtagtaacgtttgtttcgtagttctagttcgttaactaagtttgttaacgttggtaaccttagtaagtcggtacgttcggtaacgttcgggtaaccgggg

SEQ ID NO: 339665 - DNA, 570 bp, Homo sapiens
  misc_feature: GZ8MTXP01CB19G.17.10.A10.1.454.CMB.2.raw
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (257)..(258): a, c, t, g, unknown or other
  misc_feature (257)..(258): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
tcagcgtagactagcacgaccggtgctcgatttagcgtcgatctcaggggagctctgcttcagctgtgagcgcagaaggcaggactcgggacaatcttcatcatgacctgctccctctcctcctcacccttctcattcactgcacagggtcctgggcccagtctgtgttgacacagccgcctcagtgtctgccggccccggacaggacgtcaccatctcttgctctcggaaccccatgtgatcatangntcngtacnncacncgatcacncccaactcnatatatagaanataanagccacctcgacgggttcccagacgtattcncgtagctcagtctggcacgtctcgccctacgtggcacgtccgaccgcgactccgagtaccgtgggacgaggcgtaacgttggtttcgcgaccgacgaaacgtgtcgggtactttacccgacgttccgtggttaccttcgggtcggggttacgttccggcgttaacgggtacggaaccaaacggttccttacgggtaaccctccggtaaggttcccgacgaccgaaccggttccgttaaccccgg

SEQ ID NO: 339666 - DNA, 666 bp, Homo sapiens
  misc_feature: GZ8MTXP01CF4OI.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtgggcatcagtgactgtctcctgcaaggcagtgatatatcttacaacaaatataggtatgaagttgggtgacgacgaccgggacccccggacgaaggggtcttggagggtgggggtgggggtgggtcgaggcggtcgtttggacggtaaggcacgagtagtgacccgacggaagagtaggaagggacaagaacgacaacggtacttaacccgaccgggaaccccaacccccgaacggaaacccacgtacggtaccttaacaactcgactaaacgtcgaacgacgacccgtaggagacgcgtaggaaccgaccgaccggtaccgttacttagttaccgttggtacgtaccgtaacggttaatttcggttttctcgttacttacgttaccggttaaacttagtttagagttacgggtcttacgtaaggtcggtacgttacgggttaaccgttcgggtaaccggggg

SEQ ID NO: 339667 - DNA, 684 bp, Homo sapiens
  misc_feature: GZ8MTXP01C2ZG3.17.10.A10.1.454.CMB.2.raw
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (359)..(359): a, c, t, g, unknown or other
  misc_feature (359)..(359): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggcagtggatatatcttacaactaaaatntggtatgaagttgggngcgacgacggcccccggagaagggcttggaggtggggtgggggtgggtcaggtcggtctttaggacgggtaaggcacgagttangacccaacggaagagtaggaaggggcaagaacgtcaaacgtacttaacccgaccgggaacccaaccccccaacggaaacctacgaacgtaccaacatcggaacaacgtggaaccgagttcccgaggaacggacgtcggtaggaacccggtaaacgcccggggtaccgttaccttaagtttaaccggtaggtacgtaacggtaagttaacgttttcggttttcgtcgttacgtaacgtttaccgtaaagttaagtttcggaacgttacggtccttacgttaacggttacgggtacgttacgggtaaccggttccggggaacggggg

SEQ ID NO: 339668 - DNA, 670 bp, Homo sapiens
  misc_feature: GZ8MTXP01AYFXO.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaattgggtgcgacacgggccccgagaagggcttggaggtggggtggggtgggtcgaggcgggtcgtttagggaacgggtaaggcgaacgaggtagtcgaccgaaccggaagagtaggaaagggacaagtcgtacgaacgtactaacccgaaccgggaacccaccccccaaacggaaaccacgtacggtacctaacactaggaaccaagtacggaacgacgtccgaggacgtacgccgggtagaaccggaccgaaccggtcgttactagtttacgtgtacggtcggtaaagtacgtttgtttaaccgtgttcctacgttacgtaacttaagttttcgacgttacgggtcccttagttaacggttcgggtacttagggggtcccgtttcggggtaacccgggggg

SEQ ID NO: 339669 - DNA, 651 bp, Homo sapiens
  misc_feature: GZ8MTXP01C4YWH.17.10.A10.1.454.CMB.2.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacatgtgcccacgcccaggttcagttggtgcagactggggctgaggtgcagagccgtggggcatcagtgactgtctcctgcaagccagtgatatatcttacaacaaatatggtatgaagttgggtgacgacgacggccccccgganaagggtcttggaggtgggggtgggggtgggtcgaggtcggtcgtttaggacgggttaaggcgaacgagtactcgaccgaacggaagagtagggaaaacgggacaaggaacgtaccgaacggtaacttaacccgaaccggaacccaacccccgaacgaaccacaacgttacaacctatacggactaacgtacgacgaacgccgtagacgacgggtcgtacggaacgaccgaccggtccgtacttacgttaccgtgtcggacgtagtaagtttggtttacttgtacttagttaccggtaattaatttggattaagggtccttaagttagtcgggttaccgttgggttaaccgtttccgggg

SEQ ID NO: 339670 - DNA, 558 bp, Homo sapiens
  misc_feature: GZ8MTXP01DVDMR.17.10.A10.1.454.CMB.2.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (365)..(365): a, c, t, g, unknown or other
  misc_feature (365)..(365): n is a, c, g, or t
  modified_base (526)..(526): a, c, t, g, unknown or other
  misc_feature (526)..(526): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtgcgacaggcccccgganaagggctgagtgggtggggnggtcagcggntttggacggtaggcacagtatgacaccggaagatggaagggcagngtcacgacttaccaccgggacacccccacgaacacagtctacatgacaactagacgagccctagaagagacgtagacgacgacggccgtctaattactagtgcgagtaattcggtttcttggttctattccgttaaataatttggttattagggcttagtntaggacgttcggtaacgtttcgtaaccggggg

SEQ ID NO: 339671 - DNA, 577 bp, Homo sapiens
  misc_feature: GZ8MTXP01A44M0.17.10.A10.1.454.CMB.2.raw
  modified_base (256)..(256): a, c, t, g, unknown or other
  misc_feature (256)..(256): n is a, c, g, or t
  modified_base (506)..(506): a, c, t, g, unknown or other
  misc_feature (506)..(506): n is a, c, g, or t
  modified_base (552)..(552): a, c, t, g, unknown or other
  misc_feature (552)..(552): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaatntggtatgaattgggtgcgacgacggcccccggagaagggcttggaggtggggtgggggtgggtcgaggcggtcgtttggacggtaaggcacgaggttatgaccaccggaagacgtaggaaggggcaaggaacgtacaacgtacttaaccccgacgggaacccaaccccccgagaaccacagtactacgatcgacaacgtgaacgacgacctaggagagccggtagaccgaccgacggcctactagtacgngtgcgtatacttgtttaatgttcagttcgtaatattgattagtctntaagtcgacttggtctttgggcggg

SEQ ID NO: 339672 - DNA, 614 bp, Homo sapiens
  misc_feature: GZ8MTXP01AT0KZ.17.10.A10.1.454.CMB.2.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccccgganaggagtcaccatctcttgctctcgaacccccatgtgatcatntgntctgtaccagcacnccggatcacgcccccaaactcctacatactatagaanataanaacgccgaccctcgtacgggttcccctagacgtattctcgtcggcctccgaagtcgtcgctacgtcncgcccacccgtggacactccgaccgcgacctccgaagccggtagggggaccgaggaccgtaagttacgtttcgaggtccgaccaaacgacgttcggggtacctttacccgaggtcccgttggttaacccgtttcggggtcggggtttacggttccgggcgttacgggtccgggaaccaacggttcttacggtaaccccgtcgtaacggtccgacgaccccgtaaggttcccgtccccgg

SEQ ID NO: 339673 - DNA, 631 bp, Homo sapiens
  misc_feature: GZ8MTXP01C0EG7.17.10.A10.1.454.CMB.2.raw
  modified_base (250)..(250): a, c, t, g, unknown or other
  misc_feature (250)..(250): n is a, c, g, or t
  modified_base (381)..(381): a, c, t, g, unknown or other
  misc_feature (381)..(381): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtggatatatcttanaacaaatataggtatgaagttgggtgcgacgacgggacccccggagaagggtcttggagggtggggtgggggtgggtcgaggcggtacgtttgggaacggtaaggcacgtagtatcggacccacggaaagngtaggaaggacaagcgtacaacgtaactacccgaccggacccaacccccgaacgaaacacgtacgtactacgatacgacaacgtagacgacgaccgaggaacgacgcggtacggaccgaccgaccggtaccgtcttaacttacgtgtcgtagtagtaatttcgtttctgttactattacgttaaattagtttagagttacggtcttacgtaagtacgggtacgttgggtaaccgttcgggtaaccggggg

SEQ ID NO: 339674 - DNA, 727 bp, Homo sapiens
  misc_feature: GZ8MTXP01BUBIO.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaagccagtgatatatcttacacaaatataggtatgaattgggtgcgacacggcccccggagaaggctggaggtggggtgggggtggtcaggtcggtgtttaggacggtaaggacacgtagtagtcgaccaccggaagagtaggaagggacaagtaacgtcgaaacgtacttaaccccgaccgggaaccccaaccccccgaaacggaaaccacgtaaggtaccttaacacgttacggaacccaaacgttacggacggaaacgcccgtaggaaagtaccggcgtaacggaacccggaacccgaccggggtacccgttacccttaagtttaaaccgtcggtttaggaccggttaaggtaaagttttcgggtttttaacctagggtttacccgtaatttaacccggtttaaactaagtttttacggaagttacggggtaacctttaccgttaaggttacgggttacccgttaggggttaaccgttttccggggtaacccgggggg

SEQ ID NO: 339675 - DNA, 659 bp, Homo sapiens
  misc_feature: GZ8MTXP01B2T78.17.10.A10.1.454.CMB.2.raw
  modified_base (547)..(547): a, c, t, g, unknown or other
  misc_feature (547)..(547): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaactaaaatatggtatgaagttgggtgcgacgacggacccccggagaagggtcttggaggtggggtgggggtgggtcgaggcggtgtttaggaacggtaggacacgagtagtcgacccgaaccggaagagtagggaaaggggaccaaagggtaacgtaccgtaaacgtaccgtttaaaccccgaaccgggaaacccccaaaccccccgaaacggaaacccaacgtacgtacctaacactacgaaccaacgtacgaacgacgccgtagagacgcgtacggacgacgacggaccgtntacgttcgtgcgacgtagtatttgtttgtcgttagtacttcgtaattaagttgagttacgggtaacctgttaagtcggtacgttcgggtaaccgtttcgggtaacccggggg

SEQ ID NO: 339676 - DNA, 658 bp, Homo sapiens
  misc_feature: GZ8MTXP01B3XNF.17.10.A10.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (290)..(290): a, c, t, g, unknown or other
  misc_feature (290)..(290): n is a, c, g, or t
  modified_base (392)..(392): a, c, t, g, unknown or other
  misc_feature (392)..(392): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttacaanaaatntggtatgaattgggtgcgacgacggcccccgganaagggtcttggaggtggggtgggggtgggtcgaggtcgggtcgtttagggacggtaaggcaacgagtagtgacccgaaccggaagagtggaaagggcaaggngtaccgaacgtacttacccgaacgggacccaacccccgaacgaaccacacgtactacagtgacaacgtgaacgagccgtagagacgcgtacgacgacgaccggccgttacctagttaccgtggtcgtaccgtaagtaagtttcggtttaactcggttactacgtttaccggtaaaccttaagttttggaacgtttacgggtaaccctttacttaaggttacgggtacgttacggggttaacccgttttcggggtaaccccgggggg

SEQ ID NO: 339677 - DNA, 755 bp, Homo sapiens
  misc_feature: GZ8MTXP01B6BXI.17.10.A10.1.454.CMB.2.raw
tcagcgtagactagcacgaccggtgctcgatttagcgtcgatctcagggacccaaaaccacaccctccttgggagaatccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggccagtggatatatcttacaactaaaatataggtatggaagttggggtgaccgaacgacggccccccggagaagggtcgtttaggacggggtggggtgggggtggggtcgaggcgggtcgtttaggaacgggttaaggcacgagtatggaccacggaagagtaggaaggggacaaggaacgtaccgaaacgtacttaacccgaccgggaacccaaccccctaacgaaacaaccgtagtacctaacgacttacggaacctaaacgtacggaaccggtacgacccgtaggaaacggtacgtacggtacggaacccggaaccgacccgggtaccccggttacttaaaccgtttaaccggttacgggtttacgggacccggtaaaggtttaaacgtttcggttttttaacccgtaggtttaccgttaaacgttaccggtttaaaccttaagtttttaggaccgtttaagggtccttaccgttaagttacgggtaacgttcgggttaaccgtttccggggtaaccggggg

SEQ ID NO: 339678 - DNA, 554 bp, Homo sapiens
  misc_feature: GZ8MTXP01A4WOZ.17.10.A10.1.454.CMB.2.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagtacaggtgcccacgcccaggttcagttggtgcagactggggctgaggtgcagaagcctggggcatcagtgactgtctcctgcaaggccagtggatatatcttcacaaaatatggtangaattgggtgcgacaggcccccgganaagggcttggagtgggggtggggtggtcaggcggctttggacggtaaggcacagtatcgcacgaagatggaaaagggcaagatcacgataccacggaccacccccagaacacagtctacatgacaactgacgagcctagagaggctgaccgacacggcctctattactgtgcgagtaactgttttcttgtccagtcgtaacttaagtttgattaaggctcgttagtcgggttactcgggttaacgtttcggg

SEQ ID NO: 339679 - DNA, 631 bp, Homo sapiens
  misc_feature: GZ8MTXP01BBSAI.17.10.A10.1.454.CMB.2.raw
  modified_base (393)..(393): a, c, t, g, unknown or other
  misc_feature (393)..(393): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggcagtggatatatcttacaacaaatatggtatgaattgggtgcgacgacggcccccggagaagggcgttggaggtggggtgggggtgggtcgaggcggtcgtttaggaacgggtaaggcacgagtagtgacccgaaccggaagagtaggaagggacaaggngtacaacggtaacttaacccgacgggacccaacccccgaacgaacacacgtacacgactgacaacgtacgacgacgccgtagaacgacgcggtaggaaccggaaccgaccgggtccgttacttaagttacctggtcgacggtaagtaacgtttgttttctaggttctaattcgtaacttaatttagagttacggtcttgttaagtagggtcttagggtaacgtttcgggtaacggggg

SEQ ID NO: 339680 - DNA, 528 bp, Homo sapiens
  misc_feature: GZ8MTXP01AWCVB.17.10.A10.1.454.CMB.2.raw
  modified_base (362)..(362): a, c, t, g, unknown or other
  misc_feature (362)..(362): n is a, c, g, or t
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggctggagtggggtgggggtgggtcagcggctttgacggtaggcacagtatgccacgagatggaaggcagngtcacgattaccacggacacccccacgaacacagtctacatgacaactgacgagcctgagagctggaccgacgacggccgtcctattaccgtgtgcgtagtaatgtttcngttcattcgtaactatttggnttaggctctgtggcttgggtaacttcggtcggggg

SEQ ID NO: 339681 - DNA, 647 bp, Homo sapiens
  misc_feature: GZ8MTXP01C3A3M.17.10.A10.1.454.CMB.2.raw
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (432)..(432): a, c, t, g, unknown or other
  misc_feature (432)..(432): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggcagtgatatatctacacaaatatggtatgaagttgggtgcgacgacggacccccggagaagggcttggaggtggggtgggggtgggtcgaggcggtgtttaggacggtaaggcacaggtatgaccgaccggaagngtaggaaggacagcgtanacgtactacgaccggaccacccccacgaacacagtcacatcgactaacngacgagacccaggacgacgacggtacggaacggttaaccgacccgggcccgttacggtaactttaccggttaggttcgaccggtaagtaaagtttcgtttttaacgtcggttactaacgttaccggtttaaaccttaacgttttaacgagtttacgaacccgtttactaaggttcgggtacgttacgggttaaccgttcggggttaaccgggggg

SEQ ID NO: 339682 - DNA, 625 bp, Homo sapiens
  misc_feature: GZ8MTXP01EW62W.17.10.A10.1.454.CMB.2.raw
  modified_base (397)..(397): a, c, t, g, unknown or other
  misc_feature (397)..(397): n is a, c, g, or t
  modified_base (600)..(600): a, c, t, g, unknown or other
  misc_feature (600)..(600): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctggcccagtctgtgttgacacacgcccgccctcagtgtctcgccggcccccggacaggacgtcacatctctgctctacgaaccccatgtgatacattatgtcgtctggtaccagcaaccgtcccggatccaccgaccccctaaactcctactataatatagaaagtaataaacgaacgccgacccgtcgtacggggttccccacgtacgattctccgtagacctcgaagtcgtcggctacgtcncgccccaccgtcggaccacgtcccgacccgcgtaccgtacccgaggaccgggtacggggacgacggaccgtagttacgtttcgtcggacgacctaaacgtgtacgggtacttaccgtacgtccgtagtaccgttcgggttgggggttcgttccgggcgttaggtcgggaaccgagttcgttacgtaaccgtccgtaaggcccncggacccgtaagttcccgtccccgg

SEQ ID NO: 339683 - DNA, 646 bp, Homo sapiens
  misc_feature: GZ8MTXP01ECF5J.17.10.A10.1.454.CMB.2.raw
  modified_base (386)..(386): a, c, t, g, unknown or other
  misc_feature (386)..(386): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaacaaaatatggtatgaattgggtgcgacacggcccccggagaagggcttggaggtggggtgggggtgggtcgagcgggtcgtttaggacggtaagggcacgagtatgaccgaccgaagagtaggaagggccaagngtcaacggaacttacccgaaccgggacccaccccccgaacgaaaccacgtacgtacacattgacctaactcggaacgagcctaggacgagacgtacgacgaaccgaccgggccgttacttaattaccgtggttacgacgtaagttaaagtttcgttttaacgttcggttactacgtttacggtaacccttaagttttagatttacgggtccttagttaacgttggtaacccttggggtccgtttcgggttaacccggggg

SEQ ID NO: 339684 - DNA, 685 bp, Homo sapiens
  misc_feature: GZ8MTXP01CZRLA.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagagccgtggggcatcagtgactgtctctgcaaggccagtggatatatcttacaactaaatagtggtatgaagttgggtagacgacgacggacccccggaagtaagggtcgttaggagggtggggtgggggtgggcgtaggcggtcgtttagggacggtaaggcaacgtaggtagtcggacccgaaccggtaaagacgtagggaaggacgaagaacgtacaacgaacttaaccccgaccggaacccacccccgaacgaacacgagtacactatcgactaacgacgacgacgacctaggaacgacgacgggtacgaaccggaaccgaccgggtccgttactaacgttacgtacggtggtaaccgtagtaaacgttttcggtttaacgtcggttactaacgttaccgtttaaacttaaggtttagttacgttagggtccttacggtaagttcgggtaacgttcgggtaacgtttccgggtaacccgggggg

SEQ ID NO: 339685 - DNA, 701 bp, Homo sapiens
  misc_feature: GZ8MTXP01CZGSU.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtgatatatcttacaacaaatatggtatgaagttgggtgcgacgacgggccccccggagaagggtcttggagggttggggtgggggtcgggtcgaggcggtcgtttaggaacgggtaaggcacgagtagtcgaccgaaccggaagagtaggaaggacgaaggaacgttcaaccgggtacttaacccgaccggtacccaacccccgaacgaaccactacggtactaacagtcgaacaacgtacgaacgtacgaccgtaggaacgcgacggtacggaacccggaaccgacccgggtaccgttcttaacgtttaccgtacggtcggtaccgtagttaaacgttttcggtttttaacgtacggttacctaacgttaccgttaaccgtttaagtttacgagtttaccgggtaaccttacgttaaggttacgggtacgttacggggttaaccgtttcggggtaacccgggggg

SEQ ID NO: 339686 - DNA, 659 bp, Homo sapiens
  misc_feature: GZ8MTXP01AVFFO.17.10.A10.1.454.CMB.2.raw
  modified_base (374)..(374): a, c, t, g, unknown or other
  misc_feature (374)..(374): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagagcctggggcatcagtgactgtctcctgcaaggccagtggatatatcttcacaaaatatggtatgaattgggtgcgacgacggcccccggagaagggcttggagtgggtgggggtggtcagcggtctttggacggtaaggcacgagtatgccaccggaagataggaagggcaaggngtccaaggtactaccacgggaccaccccagacacgatctacagtcgacaaacgtcgaacgtacgaccgtggaaacgcgtacgtacggaaaccgcgaaccggggtcccttacgtactttaaccgtggttagccgggtaaaggttaatttcggtttttaacccgtagggttcctaaacgggttaccccgttaaacttaaagtttttaccgaagtttacgggtaaccctttacgtaaacggtttgggtaagtttacgggtaacgttttccgggttaacccgggggggg

SEQ ID NO: 339687 - DNA, 682 bp, Homo sapiens
  misc_feature: GZ8MTXP01DINIW.17.10.A10.1.454.CMB.2.raw
  modified_base (257)..(257): a, c, t, g, unknown or other
  misc_feature (257)..(257): n is a, c, g, or t
  modified_base (385)..(385): a, c, t, g, unknown or other
  misc_feature (385)..(385): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaatntggtatgaagttgggtgcgacacggcccccggagaagggctggaggtggggtggggtgggtcaggcggtcgtttagggacggtaaggcaacgagtatcgacccacggaagagtaggaaagggcaaggngtacgaacgtacttacccgaccgggacccaacccccgaacgaaaccacacgtctaacagtacgacaacgtgaacgacgcccgtaggaacgacgacggtacggaaccggaaccgacccggtaccggttacttacgtttaccgtaggtcggtaccggtaagtaacgtttcggtttttaacgtacgttacgttaacgttacccggttaaacttaagttttaggacgttaacggggtcctttaaccgtaagtttcggggtaaccggttcggggttaaccgtttccggggtaacccgggggg

SEQ ID NO: 339688 - DNA, 630 bp, Homo sapiens
  misc_feature: GZ8MTXP01B3BKW.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaagcagtgatatatcttacaactaaatgtggtatgaagttgggtgacgacgacgggacccccggagaagggtcgttggagggtggggtgggggtgggtcgaggtcggtcgtttgggaaccggtaaggccacgtagtagtcgacccgaaccggaaagagtagggaacgggaacaggtaagtaccgaacgtacttaaccccgacggaccccaaccccgaacgaaccacgacgtactacatacgactaaacgtgacgacgcgagagacgcgtagaccgacgcggtccgtactagttactggtcgtagtagttacgttgttttctgttctacgttcgttaaactagtttagcttacgggtccttagtaagttcggtacttcgggttaacgttcgggtaaccggggg

SEQ ID NO: 339689 - DNA, 659 bp, Homo sapiens
  misc_feature: GZ8MTXP01BA6RO.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaatatggtatgaagttgggtgcgacgacgggcccccggagaagggtcttggagggtggggtgggggtgggtcgaggcgggtcgtttagggacggtaaggcacgtagtatgacccgaaccggaagagtaggaagggacaaggaagtcgaacggtacttaacccgaccgggaacccaacccccgaacggaaaccacgacgtacacacgtgaccaacgtgaaccggacgccgtagacgacgcgtacggaacgtaccgaccggtccgtacttacgttactggtgtaccggtaagttacgtttcgttttaactcggttctaacgttacggttaaacttaagtttgttaacgttacgggtcttacgttaagttcgggtacgttcgggtaaccggtttcgggtaaccggggg

SEQ ID NO: 339690 - DNA, 651 bp, Homo sapiens
  misc_feature: GZ8MTXP01CT0TL.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactgggctgagtgcagagcctgggcatcagtgactgtctctgcaaggcagtgatatatcttcaacaaatatggtatagaattgggtgcgacgacggcccccggagaagggtcttggaggtggggtgggggtgggtcaggcggtcgtttgggaacggtaaggcgacgaggttatgacccgaccggaagtagtagggaagggtaccaagaacgtacaacggtacttaacccgaccgggaacccaccccccaaaggaaacccactacggtacctacagtacgactaaccgtagaccgacgtccgtaggagacgacggtaggaaccgaccgacgggtcccgtattacgttaccgtggtacgtacgtaagttaactttggttttcctggttacctagttcgttaaacttagttttagacgttacggtcttattaaggttacggtacgttcgggttaacgtttcgggtaacccggggg

SEQ ID NO: 339691 - DNA, 659 bp, Homo sapiens
  misc_feature: GZ8MTXP01DHN4L.17.10.A10.1.454.CMB.2.raw
  modified_base (277)..(277): a, c, t, g, unknown or other
  misc_feature (277)..(277): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcaggacgtggggctggaggtgcaggaagccgtggggcatcagtgactgtctcctgcaaggcagtgatatatcttacaacaaatgtggtatgaagttgggngcgacgacggcccccggagaaggtcgttggagggtggggtgggggtcgggtcgaggtcgggtcgttttagggacgggtaagggcacgtagtagtcgaccgaaccgaaggtagtagggaacgggaacaaggaacgtacaaccggtaacttaacccgacccggaacccacccccgaaacggaaccaactacgtactaacgaactcgactaaacgtcggaacgagtccaggagacgacggtacgaccgaaccgaccgggtccttacgttacgttacgtagtcggtacgtaagtagtttcgttttctgttctaacgttacggttaacttaagtttcgagttaggtcctagtaagttggtacgttggtaacgtttcgggtaacgggg

SEQ ID NO: 339692 - DNA, 667 bp, Homo sapiens
  misc_feature: GZ8MTXP01AJ1DQ.17.10.A10.1.454.CMB.2.raw
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (475)..(475): a, c, t, g, unknown or other
  misc_feature (475)..(475): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctctgcaaggcagtgatatatcttananaaatntgtatgaagtggtgacgacgacggccccggagagggtcttggagggtgggtgggggtggtcgaggtcggtgtttagggacgggtaaggcgacgtagtagtcgacccgaacggaaagagtagggaagggacaaggtaacgtacaaccggtacttaaccccgacgggacccacccccgaacgaacacacgtacacatcgacgtaacgacgaacgacgacccgngaagcggactacggaccggaaccgaccggtccgttacgttacgttacgtcggtgtacggtacttaagtttcgttttcgtggtttactaacgtttacccggtaaatttaagtttgggttaacgttacggggtaacccttggtaacggttacgggtacgttacggggttaacgttccgggggttaacccggggg

SEQ ID NO: 339693 - DNA, 701 bp, Homo sapiens
  misc_feature: GZ8MTXP01DBAQM.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggccagtgatatatcttacaacaaatatggtatgaagttggtgcgacgacggcccccggagaacgggtcttaggagggtggggtgggggtgggtcgaggcgggtctttacgggaacgggtaaggcacgtagtagtcggacccgaccggaaaggagtagggaagggtacgaaggtgtaccgaaccgtaacgttacccgaacccgggaacccaaccccccgaaacgaaccacgtacgttactaacagttacgaacaaccgtacggaacggtacgaccgtaggaacgacggacgtacggaaccggtaccgaccgggtcccgttacgttagttaaccgttggtacggtaccgtagggttaattttcggttttcttggttacttaacgttcgttaaacgtttagtttaacgttgttacgggtcttacgtaaggttcggtaacgttcgggttaaccgtttcggggtaacccggggg

SEQ ID NO: 339694 - DNA, 595 bp, Homo sapiens
  misc_feature: GZ8MTXP01B33RM.17.10.A10.1.454.CMB.2.raw
  modified_base (472)..(472): a, c, t, g, unknown or other
  misc_feature (472)..(472): n is a, c, g, or t
  modified_base (528)..(528): a, c, t, g, unknown or other
  misc_feature (528)..(528): n is a, c, g, or t
  modified_base (550)..(550): a, c, t, g, unknown or other
  misc_feature (550)..(550): n is a, c, g, or t
  modified_base (560)..(560): a, c, t, g, unknown or other
  misc_feature (560)..(560): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttacaactaaatatggtatgaagttgggtgcgacgacggccccgagagggtcttggaggtgggggtgggggtgggtcaggcggtcgtttggacggtaaggcacgtaggtatgaccaccggaagagtaggaaagggcaaggaagtaccgaacgtacgttaacccgaccgggaccacccccgaagaacactacgtactacagtcgaacaacgtgaacgacgcctagganacgcgtagacgaccgacggccgttctagttcgtgtcgacgtagtaacgttgtttcngttctattcgtaactagtttgnttacggtctntaagtcggacttcggtaacgttcgggtaaccgggg

SEQ ID NO: 339695 - DNA, 681 bp, Homo sapiens
  misc_feature: GZ8MTXP01CLDIN.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcgccggccccccggacaggaggtcaccatctctgctctacgaaccccccaatgtgattcaattatgtgtcctggtaccagccaaccgtcccggatccaccgacccccaaactcctacaatatatagaaagtaataaataacgccgtaccctcgtacggggtttcccctacggaccgtatttcctacgtacggcctcccgaaagttctgggcctaccgtctcgcccctacccgtgggaccacgtccaccgcgacctaccgaggaccgtggggaccgagggcccgtaagttacgtttcgtaggccgtaccaaacgtcgtcggggtactttacccgacgtcccgttacggtaccgtttccggtggggggttcgttccggggtacgttaacggggttaccgggaaccgttaaacggttcccgttacgggtaaccccggttccgtaacgggttccgacggttacccccgaaacggggttccccttcccccggg

SEQ ID NO: 339696 - DNA, 653 bp, Homo sapiens
  misc_feature: GZ8MTXP01AY97N.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggcagtggatatatcttacaacaaatatggtatagaagttgggtgcgacgacggcccccggagaagggcttggaggtggggtgggggtgggtcgaggcgggtcgtttagggaacgggttaaggcgaacgtaggtagtcggacccgaaccggaagagtagggaagggacaaggaacgtacgaacgtacttacccgaaccgggacccacccccgaagaaccacacgtactacagtcgacaactggacgacgccgtagagacgcgtaggagtcgaccgaaccgggtcccgttagttaacgttacgtggtacgacgtaacgtaagtttcggttttcttggtaccttagttacgttaacttaagtttcgagttaacgggtacttcgttagtcgggttaacgttcgggttaaccgtttaacccggggg

SEQ ID NO: 339697 - DNA, 648 bp, Homo sapiens
  misc_feature: GZ8MTXP01A4M1I.17.10.A10.1.454.CMB.2.raw
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttacaacaaaatatggtatgaagttgggtgcgacgacggcccccggagaagggcttaggagggtggggtgggggtgggtcgaggtcggtcgtttggacgggtaaggcaacgagtatggacccaacggaagagtaggaagggtacaaggaacgtcgaaacccggtattaacccgacgggacccaaccccccaaggaaaccaccgagtactaacgatacgacgaactagaacgacgccgtagaacgcgacgtacggaaccgtaccggaccgggtcctactacgtttacgtaggtgacggtaagtaacgtttggtttctaggttctaacgttccgtaaattaagtttgttagttacggtccttcgtaagttcgggtacgttacgggtccgttaacgggtcccggggg

SEQ ID NO: 339698 - DNA, 591 bp, Homo sapiens
  misc_feature: GZ8MTXP01BKCZM.17.10.A10.1.454.CMB.2.raw
  modified_base (449)..(449): a, c, t, g, unknown or other
  misc_feature (449)..(449): n is a, c, g, or t
  modified_base (542)..(542): a, c, t, g, unknown or other
  misc_feature (542)..(542): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtgatatatcttacaacaaatatggtatgaagttgggtgcgacgacggcccccggacgaagggtcttggagggtggggtgggggtcgggtgaggcggtcgtttaggacgggttaacgggctaacgaggtagtcgcccgaaccggaaagagtaggaaggggacaggaagtcgaacgacttacccgaacggacccacccccaacgaacacacgtacanacgtgaccaactgaacgcgcctggagacgcgtacgaacggaccgaccggtccgtcttacgttactggtcgtcgtagtacttggtttctgttcnttcgtatattgnttcgtntctgtggacttcggtaacgttcgggtcgggg

SEQ ID NO: 339699 - DNA, 664 bp, Homo sapiens
  misc_feature: GZ8MTXP01EIBFB.17.10.A10.1.454.CMB.2.raw
  modified_base (349)..(349): a, c, t, g, unknown or other
  misc_feature (349)..(349): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctctgcaaggcagtggatatatcttacaacaaatatggtaatgaagttgggacacgacggccccgagaggcttggaggtgggggtgggtggtcaggtcggtctttggacgggtaaggcacgagttangacgtaacccggaagagtagggaacggggctaaaggacgtcgaacgtaacgttaacccgaacccggaccccgaaccccccgaagaaacccaactaggttacctaacagttacggaccaaacgttcggacgacgtccgtaggaagacacggttacgggaaccggtacgacccggtacgttacttagttacgtcggtacgcgtaaagttacgttttcgttttgaagtttaccgagtttaccgttaacgtaattttaggacgttaggttccttaataggtccggtaagtcgggttacttcggggttcgggaacccggg

SEQ ID NO: 339700 - DNA, 633 bp, Homo sapiens
  misc_feature: GZ8MTXP01DAAVJ.17.10.A10.1.454.CMB.2.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttnacaaatatggtatgaattgggtgcgacacggcccccggagaagggcttggaggtggggtgggggtgggtcaggcggtgttttggaacgggtaaggcaacgagtatcggacccaaccggaagagtaggaaggggacagaagtcaacgtacttaacccgaccgggaacccacccccgaacgaaacacacgtctaacagttcgacaacgtgacgagcctagagacgcgtacgacgaccgaccggtccgttctagttacgtggtagtacgtaagtaacgtttgttttaacgtgttcctaattcgttaaactaagttttaggacttaagggttccttacgttaagttacgggtacgttacggggttaaccgtttcgggtaaccgggggg

SEQ ID NO: 339701 - DNA, 689 bp, Homo sapiens
  misc_feature: GZ8MTXP01AOZYZ.17.10.A10.1.454.CMB.2.raw
  modified_base (205)..(205): a, c, t, g, unknown or other
  misc_feature (205)..(205): n is a, c, g, or t
  modified_base (271)..(271): a, c, t, g, unknown or other
  misc_feature (271)..(271): n is a, c, g, or t
  modified_base (335)..(335): a, c, t, g, unknown or other
  misc_feature (335)..(335): n is a, c, g, or t
tcagcgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtggggtggggtggtcaggcggctttggacggtaagcacagtatgcaccgaaganggaaagggcagagtcacgattaccacggacacccccagaacacagtctacatgacaactgacgngcctgagagctgacgacaacggccgtctatactgtgcgagaattgtttctgtactatcgtaactaatttgattaggctacttagtcggtaacgttggtaacgttcggttcgggggacccgaacgggggtacccctaaccgggggttgtaacgttcccgggttcgttcccgaaacttcccgaaacccgggtcccctaaccccggaaaccccggtaaaaccgggggccccctaaaccggtttcccccggggtttccccctttttccccccccggttccggggaaccccctaaaccccggtttccccctaacccggaacccggttaaccgggccccttaaccccggtttcccggggg

SEQ ID NO: 339702 - DNA, 696 bp, Homo sapiens
  misc_feature: GZ8MTXP01CLASI.17.10.A10.1.454.CMB.2.raw
  modified_base (251)..(251): a, c, t, g, unknown or other
  misc_feature (251)..(251): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcaggacgtggggctggaggtgcaggaagccgtggggcatcagtgactgtctcctgcaagcagtgatatatcttanaactaaatataggtatgaagttgggtgacgacgacggccccggagaagggtcttggagggtgggggtgggggtgggtcgaggcgggtcgtttagggaacgggtaaggacacgagtagtacgacccgaacggaagagtagggaaggaacaggaacgtcgaaacgtacgttaaccgacccgggaacccaacccccgtaacgaaccacgtagtacctacgagtagaccaacgtacggaacgacgaccgtaggacgacggtaccgacggaccggaccgtaccggggtacccttacgttacgttacgtagtacggtaccggtaagttaacgtttcggttttaacttcggttacttaaacgtttaccggttaaacttaggttttacgacgtttcgggtcttacgttaacggtacggtacgttcgggtaacgtttccggggtaaccgggggg

SEQ ID NO: 339703 - DNA, 632 bp, Homo sapiens
  misc_feature: GZ8MTXP01DSU04.17.10.A10.1.454.CMB.2.raw
  modified_base (410)..(410): a, c, t, g, unknown or other
  misc_feature (410)..(410): n is a, c, g, or t
  modified_base (483)..(483): a, c, t, g, unknown or other
  misc_feature (483)..(483): n is a, c, g, or t
  modified_base (586)..(586): a, c, t, g, unknown or other
  misc_feature (586)..(586): n is a, c, g, or t
tcagcgtagactagcacgaccggtgctcgatttagcgtcgatctcagggacccaaaaaccacacccctccttgggagaatcccctagatcacagctcctcaccatggactggacctggagcatcctttcctggtggcagcaggcacaggtgcccacgcccaggttcagttggtgcagacgtggggctggaggtgcagaagccgtggggcatcagtgactgtctcctgacaaggccagtggatatatcttacaataaatagtggtaatagaagttgggtgacgaacgaccggcccccggaacgaagggtcgttaggagggtggggtgggggtggggtcgaggtcgggtcgttttagggaacggtaaggacacgtagtatcgaccgaaccggaaagagtaggaagggacagngtacaacgtacttaacccgaccggaccaacccccgaacgaacacacgtactacatcgaacaacgtcgacgacnccgagaacgacgacgtacggaacgtaaaccgccgggtcccttacttacgttaccgtgtacgtacgtagtactttgtttctgttctattcgtaattagtttagngttacggtcttagttgtaggtacgttcggtaacgttcggtcggggg

SEQ ID NO: 339704 - DNA, 693 bp, Homo sapiens
  misc_feature: GZ8MTXP01BHOYL.17.10.A10.1.454.CMB.2.raw
  modified_base (250)..(250): a, c, t, g, unknown or other
  misc_feature (250)..(250): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttanaactaaatgtgtatgaattgggtgcgacgacggccccggagaaggcttggaggtggggtgggggtggtcgaggtcggtgttttacggaacgggttaaggcgaacgtaggtacgtcggacccgaaccggaaagagtaggggaacggaaccaaggtcgtacgtaaaccggtaatttaacccccgaaccgggaacccaaccccccgaaacgtaaaccacgtaacgtacctaacgacttacgaacctaaccgtgaaccgacgaccctaggaagaccgacggtacggaaaccggtaccgaccgggtaccttcgttaacgttacgtggtacgtacggtaagttaacttttgttcgttgttactacgttaccgtaatttaaagtttggttacgttacggtaacttccgttaaggtcgggtacgttacgggttcgttcgggtaaccggggg

SEQ ID NO: 339705 - DNA, 622 bp, Homo sapiens
  misc_feature: GZ8MTXP01CO8EZ.17.10.A10.1.454.CMB.2.raw
  modified_base (408)..(408): a, c, t, g, unknown or other
  misc_feature (408)..(408): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggccagtggatatatcttacaactaaatagtggtaatgaaagttgggtgcgacgacgggcccccggaagaagggtcttaggaggtggggtgggggtgggtcgaggtcggtcgttttagggaacggtaaggctaacgagtatcggaccgaaccggaaagagtaggaagggacaagngtacaacgtattacccgaacggaccacccccaaagtaacacaggtactaacacgtacgactaacgagacgagcctagagagcggtacgaacgaccgacggtcgttactagttacgtgtcgtacgtagtaatttggtttctaggttctagttcgtaaagttattagttagttaggtcttatcgtaggtacttcggttaacgttcggtaaccgggg

SEQ ID NO: 339706 - DNA, 696 bp, Homo sapiens
  misc_feature: GZ8MTXP01C1FYX.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttacaactaaaatgtggtatgaagttgggtgcgacgacggcccccggagaagggtcttggaggtggggtgggggtgggtcgaggcggtcgtttagggaacggtaaggcaacgtagtagtcgacccgaaccggaaagagtagggaaagggacaaggcgtacgaacgtaacttaaccccgaaccgggaaccccaacccccgaacgaaaccacgacgtactacgaatcgaacaacgtagaaccgacgaccgtaggaacgacgcggtaacggaaccggaaccgacccgggtaccgttacttaacgtttaccgtaggtacgtaacggttaagtaaacgttttggttttaacctaggttacgtaacttaccggttaaacttaagttttacgagtttacggtcctttagtaaggttacgggtacgttacgggttaaccgttcggggtaaccggggg

SEQ ID NO: 339707 - DNA, 661 bp, Homo sapiens
  misc_feature: GZ8MTXP01DA6J8.17.10.A10.1.454.CMB.2.raw
  modified_base (251)..(251): a, c, t, g, unknown or other
  misc_feature (251)..(251): n is a, c, g, or t
  modified_base (448)..(448): a, c, t, g, unknown or other
  misc_feature (448)..(448): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctctgacaaggcagtgatatatctacaanaaatgtggtatagagttggtgcgacgaccggaccccgaagaacggtctaggaggggttggggtgggggtcgggtacaggtcggtcgtttagggaacgggtacgcaacgtagtagtcgacccgaacggaagagtaggaagggcaagtcgacgaacgtaactacccgaccggaaccccaccccaacgaacacagtacanacgtgaacagtacgacgacgtaccgagacgacgtcgtacggaacggaccgaccggggtaccttacttaacgttacggtcgaggtacgtaagtaagttttcggtttaacttgttaccgtagttccggtttaaattaagtttgaagttacgggtcttacgttaacggttacgggtaacggttcggttaacccggtttcgggggtaacccgggggg

SEQ ID NO: 339708 - DNA, 601 bp, Homo sapiens
  misc_feature: GZ8MTXP01DB94B.17.10.A10.1.454.CMB.2.raw
  modified_base (366)..(366): a, c, t, g, unknown or other
  misc_feature (366)..(366): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctctgcaaggccagtggatatatcttcacaaatatggtatgaattgggtgcgacaggcccccggacaagggcttgaggtggggtggggtgggtcagcggcgtttggacggtaggcacagtatgccaccgaagagtagaaggcagngtcacgataccacggacaccccagacacagtactacgatgacaactgacgagcctgagacgcgtacgacgacacggtccgtacttacgttacgtagtcggtacgtaagtaaagttcgtttttaacgtgttacgtaacgttcggttaaaccttaagttttacggagtttaaacggggtcttaccgttaagtttcgggacgtttacggggtaacccttttcgggttaacccgggggg

SEQ ID NO: 339709 - DNA, 662 bp, Homo sapiens
  misc_feature: GZ8MTXP01DRSAD.17.10.A10.1.454.CMB.2.raw
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (441)..(441): a, c, t, g, unknown or other
  misc_feature (441)..(441): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcaggaagccgtggggcatcagtgactgtctctgcaaggcagtgatatatcttacaataaatntggtatgaagtggngcgacacggccccgagaggctggnggtgggngggtggcaggcggtcgtttgggaacggtaaggcacgtagtatcggaccgaacggtaagagtaggaagggacagtaacggtacacgtaaactaacccggaccggaacccacccccgaaacgaacacgacgtactaacncgtacgaacaacggtacgaaccggtaacgaccgtaggaacgtacgggacgttaacgggaacccgaaccggtacccgggtaccgtcttaaacgttcgtaggtcgagttagtaacgttttgtttaactcggttactacgttaccgttaaagttagtttaaccgttgttacggttctaacgttggtacggtacgttacgggttccgtttcggggtaaccggggg

SEQ ID NO: 339710 - DNA, 761 bp, Homo sapiens
  misc_feature: GZ8MTXP01EHQKO.17.10.A10.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcaggttggtgcagacgtggggctggaggtgcaggaagccgtggggcatcagtgactgtctcctgcaaggcagtgatatatcttacaanaaatatggtatgaagttgggtnacgacgaccggcccccggaagaagggtcgttaggagggtgggggtgggggtggtcgagggtcgggtcgtttagggaacgggttaaggcaacgtaggtagtcggacccgaaccggaaagagtagggaaacggggacaaaggtaacgtaccgtaaacggtaaccgttaaaccccgaaaccggggtacctaacccgtacccccaaagaaacacgtaacgtacctaacagttaccgaccgtaaacgtcggaaacggacgtcccgtaaggacggacggtccggtaacggaaccgtaacccggaccgggtaccccgtttatttaacgttaaccggttggaccggtaacggttaaagttaacgttttcgggtttttccaggttaaccgttaactttaacccgggttaaattaaagttttggaaaacgttcgggttaccttaacggtttaagggtccggttacgttaacgggtttaacccgtttccgggggg

SEQ ID NO: 339711 - DNA, 714 bp, Homo sapiens
  misc_feature: GZ8MTXP01EO0ST.17.10.A10.1.454.CMB.2.raw
  modified_base (252)..(252): a, c, t, g, unknown or other
  misc_feature (252)..(252): n is a, c, g, or t
tcagcgtagactagcacgaccggtgctcgatttagcgtcgatctcaggggacccaaaaaccacacccctccttgggagaatcccctagatcacagctcctcaccatagactggacctggagcatccttttcctggtggcagcaggcacaggtgcccacgcccaggttcagttggtgcagactggggctggaggtgcagaagccgtggggcatcagtgactatctcctgacaaggccagtggatatatcttanaactaaaatagtggtatagaagttgggtgcgaacgacggacccccggaagaagggtcttaggacgggtggggtgggggtcgggtcgaggtcggtacgttttagggaacgggttaaggcaacgtagtagtcgaccgaaccggaaagagtaggaaggacaagcgtacgaaacgtacttacccgaaccggacccaaacccccgaaacggaaaccacgaacgtacctaacgactacggaaccaacgtacgaacggacgacccgtaggaacgacgacggtacggaaccggaccgaccgggtcccgttacttaacgtttaccgtaggtcggtaccggtaaagtttaacgttttcggttttaacccgttgggttaaccgtaactttacgttaaccgttaaagtttacgagttacgtaacgttactaaggtaccggtagttacgggtaaccgttttcggggaaccggggg

SEQ ID NO: 339712 - DNA, 667 bp, Homo sapiens
  misc_feature: GZ8MTXP01A8RUH.17.10.A10.1.454.CMB.2.raw
  modified_base (259)..(259): a, c, t, g, unknown or other
  misc_feature (259)..(259): n is a, c, g, or t
  modified_base (355)..(355): a, c, t, g, unknown or other
  misc_feature (355)..(355): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacaacaaaatntggtatgaagttggtgcgacgacggccccggagaagggcttggagggtggggtgggggtggtcgaggcggtcgtttggacggtaaggcacgagtangacccacggaagagtaggaaggacaagcgtacacgaacgttacccgaaccgggaacccacccccgaaacgaaccaccaagtcctaacatacgaccaacgtggaaccgacgacccgagagaacgcggtaacgaaccggaccgacccgggtaccgttacttaacgttaccgttaggtacgtaccggttaaggttaacgttttcggtttttaacgtacggttaccttaacgttaccgttaaacgttaagtttagttaagttacggtcttacgtaagtacggtacgttacgggtaacgtttcgggtaacccggggg

SEQ ID NO: 339713 - DNA, 647 bp, Homo sapiens
  misc_feature: GZ8MTXP01AY2IP.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaactaaaatatggtatgaagttgggtgcgacgacggcccccggagaagggcttggaggtggggtgggggtggtcgaggcggtgtttggacggtaaggcacagtatgccaacgagagtaggaagggcaaggtcgtacgaacgtaacttaaccccgaccgggaacccaacccccgaagaaccacgacgtacctacagtcgaacaacgtagaaccgagccgtagacgtacgcggtaggaaccgacgaccggtccgtacgtagttaccgtggtacgtacgtaagttaacgtttcgtttaacgtgttaccgtagttacccggttaaattaagtttacggagttaacgggttccttacgtaagttcgggtaaccgttggtaaccgtttcgggtaaccggggg

SEQ ID NO: 339714 - DNA, 616 bp, Homo sapiens
  misc_feature: GZ8MTXP01AE37S.17.10.A10.1.454.CMB.2.raw
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcgccggcccccgganaggagtcaccatctctgctctacgaacccccatgtgattcatngtctctgtacancactccggatcacgccccaactccacatatatagaanataanacgccgacctgacgggttcccngacgtattctctgtcctccgaagtcgtgctacgtcncgcccacccgtggcctatcccgaccgccgcctaccgacggacggtcgggggacgacgggtaccgtaacgttacgtttcgtaggccgtaaccgaaacgtacggtacggggtaacctttcccgaacgttcccgtacggtaccgtttcgggtcgggggttcggttcgggtacgttacggggtacgggaacccgaggttccgttacgtaacccggtaccgtaaggtaccgacgttacccgaacgcccgtaaccccgg

SEQ ID NO: 339715 - DNA, 752 bp, Homo sapiens
  misc_feature: GZ8MTXP01AS7EX.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaactaaaatatggtatgaagttgggtgcgacgacggcccccggagaagggtcttggagggtgggggtgggggtgggtcgaggtcgggtcgttttagggaacgggttaaggcaacgaggtatcggaccgaaccggaaagagtagggaacggggacgaaggaacgttacgaaaccgggtaacctttaaaccccgaaccgggaaccccaaaccccccaaacaaaacccgacaacgtacctaacatacggaccaaaccgtcggaaccggaacgtacccgtaggaacggacgaccggttacggaaacccggaaccgtaccccggggttacccgttacgttaaaccgtttacgtcgggttacgaaccgggtaacgttaaagtttcggtttttaacgtcgttacgtaacgttacggttaaaccttaaagttttggaacgtttaacgggtcctttaacgttaaggttcggggtacgtttacggggtccgttttcggggtaacccgggggg

SEQ ID NO: 339716 - DNA, 602 bp, Homo sapiens
  misc_feature: GZ8MTXP01DF9F5.17.10.A10.1.454.CMB.2.raw
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (376)..(376): a, c, t, g, unknown or other
  misc_feature (376)..(376): n is a, c, g, or t
  modified_base (420)..(420): a, c, t, g, unknown or other
  misc_feature (420)..(420): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttacaacaaaatntggtatgaagttgggtncgacgacgggcccccgagaagggtcttggaggtggggtggggtggtcaggcggtctttggacggtagcacagtatgaccacggagacgtgaaggggcagngtcaacgtatacccaacggaccacccccgaagaacacagtacanatacgacaaacgtgaacgagcctaggagacgcgtacggaaccgaacgaccgggccgttactaagttaccgtgtcggagtaacgtaatttggttttctggttacctaagttcgttaaactaagttttcgagttacggtcttacgttaagtcgggtacttggtaacccgtttggtaaccggggg

SEQ ID NO: 339717 - DNA, 703 bp, Homo sapiens
  misc_feature: GZ8MTXP01AYM7N.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtggatatatcttacaactaaatagtggtatagaagttgggtgcgacgacggcccccggagagggtcttggaggtggggtgggggtgggtcgagggtcggtcgtttagggacggtacgacgacgacgtagtacgccgaaccggaacggaagtaggaagggaacggacgaagtacgtaaccgaacgtaaccgtaccggacccgaacccccgaaacccgaaacgactaacgtacgtaacctacgtacgtaccgaactacggaccggacgacgtaccgaggacgcggtacgtaccggaaccgacccggtaccgtaccgttacgttaaccgttggtggtaccggtaacgttaagtttcgttttaacgttacgttacgtaacgttcggtttaaaccttaagtttaacggttgttacggtaacttccgttaaggtacggtacggttacgtaacgggttaacgggttcccgggggg

SEQ ID NO: 339718 - DNA, 706 bp, Homo sapiens
  misc_feature: GZ8MTXP01E4J1R.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtgggcatcagtgactgtctctgcaaggcagtgatatatcttacaacaaatatggtatgaattgggtgcgacgacggcccccggacgaagggcttggaggtggggtgggggtgggtcgaggcgggtcgtttagggacgggtaaggcgacgagtatcggacccaaccggaagagtaggaaggggacaagggaacgttaccaacgggaacttaacccggaaccggaaccccgaaacccccccgaaacggaaaccaaccgaacggttacctaaaccgaagttcgaaccaaacgtggaaaccggaggccccgtaggaacgaggccgtaggaaccggaaccgacccggcccgttacttaacgttaccgtggtacgtaccggtaagtaagttttggttttaactcggttactaacgttacccggtaaactttaagtttacgttaagttacgggtccttacgttaaggtcgggtacgttcgggttaacccgtttcgggtaacccgggggg

SEQ ID NO: 339719 - DNA, 738 bp, Homo sapiens
  misc_feature: GZ8MTXP01B56TG.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtgatatatcttacactaaatatggtatgaagttgggtgcgacgacggcccccggagaagggtcgttggagggtggggtgggggtgggtcgaggcggtcgtttagggacgggtaaggcaacgtagtagtggacccaaccggaagagtaggaaagggacaaggaagtaccgaaacgtaacttaacccgaaccgggaacccaaccccccgaaacgaaaccaacgacggtactaacagtacgaaccaacgtcgaaccggacgtcccgaggaacggacgaccggtaacggaaccggaaccgacccgggtacccgttacgttaacgtttaccgtaggttacggtaaccgtaggttaaacgttttcggttttaacccgttggttaccgttaacgtttaaccgttaaaccgtttaaggttttacggttagttacgggtttaaccttaacgtttaacggttacgggttacggttacggggttaacccggtttcggggttaacccggggggg

SEQ ID NO: 339720 - DNA, 633 bp, Homo sapiens
  misc_feature: GZ8MTXP01BQUPR.17.10.A10.1.454.CMB.2.raw
  modified_base (258)..(258): a, c, t, g, unknown or other
  misc_feature (258)..(258): n is a, c, g, or t
  modified_base (430)..(430): a, c, t, g, unknown or other
  misc_feature (430)..(430): n is a, c, g, or t
  modified_base (511)..(511): a, c, t, g, unknown or other
  misc_feature (511)..(511): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatcttacaactaaatntaggtatgaagttgggtgcgaacgacggacccccggagagggtcttgggagggtggggtgggggtcggtcgaggtcggtcgtttagggaacggtaagcctaagagtagtcgaccgaacgaagagtaggaaggacagcgtacacgtactaccgacggacccaccccagaacanagtacacgatcgaacaactcgaacgagccagacgtagcgtaacgaccgaaccgccgtaccgtacttagttcgtaggtacgngttaacgtattttcggtttctacgttcgtaaacgtttcgttaacttaagtttaggacgttacgggtaaccttaggttaacgtcgggtacggttcgggtttaaccggttcgggtaaccggggg

SEQ ID NO: 339721 - DNA, 648 bp, Homo sapiens
  misc_feature: GZ8MTXP01ER0XQ.17.10.A10.1.454.CMB.2.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtggatatatcttacaactaaatntaggtatgaagttgggtgacgacgacggccccggagagggtctggagggtggggtgggggtggtcgaggcggtcgtttagggaacggtaggcacgagtagtcgaccgacggaagagtaggaagggacagcgtacgaacgtaacttacccgaaccggaacccacccccgaagaaccacagtacctacacgtacgaacctaacgtcggaaccgacgccgtaggaacgacgcggtacggaaccgaccgaccggtccgtacttacgttacgtgtgtacggtagttacgtttggtttaacgtgttacgtagttaccgttaattagtttagttagttacgggtcttacgttaacgtgggtaccgttagggttccgtttcgggggtaaccggggg

SEQ ID NO: 339722 - DNA, 653 bp, Homo sapiens
  misc_feature: GZ8MTXP01DL61T.17.10.A10.1.454.CMB.2.raw
  modified_base (250)..(250): a, c, t, g, unknown or other
  misc_feature (250)..(250): n is a, c, g, or t
  modified_base (604)..(604): a, c, t, g, unknown or other
  misc_feature (604)..(604): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatcttanacaaatatggtatgaagtgggtgcgacgacggccccggacgaagggtcttggagggttgggggtgggggtgggtcgaggtcggtcgttttagggaacgggtaaggcgaacgtaggtagtcgacccgaaccggaaagagtaggaaaggggaccaaggaacgtaccgaacgtaaccgttaaccccgaacccgggaacccaacccccgaaacgaaaccacgaacgttactacagtcgaacaacgtacggacgacgcctaggaagacgcggtacgaacgaaccgaccgggtcctacttacgttactggtcgtacgtatatttggtttaactgttactacgttcgtaaattagtttagngttacgtcttagtaagttggtacgttggttaacgttcgggtaaccgggg

SEQ ID NO: 339723 - DNA, 648 bp, Homo sapiens
  misc_feature: GZ8MTXP01ENNKB.17.10.A10.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (392)..(392): a, c, t, g, unknown or other
  misc_feature (392)..(392): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtgatatatcttacaanaaatntggtatgaagttgggtgcgacgacggcccccggagaagggtcgttggagggtggggtgggggtgggtcgaggcgggtctttgggaacggtaaggcacgagtagtcgacccgaacggaagagtaggaagggacaggngtacaacgtacgtacccgaccggaacccacccccgaagaacacacgtactacagtcgacaacgtgacgacgccgtaggaacgacgcggtacgaaccggaccgaccggtccgttacttaacgtttacgtaggttacgacggtaagttacgtttcggttttaactcggttactaacgtttaccgttaattaagtttcgaagttacggtccttgttaagtgggtaccgttagggttaaccgtttcgggtaaccgggggg

SEQ ID NO: 339724 - DNA, 704 bp, Homo sapiens
  misc_feature: GZ8MTXP01D5PW9.17.10.A10.1.454.CMB.2.raw
  modified_base (404)..(404): a, c, t, g, unknown or other
  misc_feature (404)..(404): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggcagtggatatatcttacaacaaaatatggtatagaaagttgggtgacgacgacgggccccccggacgaagggcttggagggtggggtgggggtgggtcgaggtcggtcgtttggaacggtaagggcaacgagtagtcgaccgaaccgaaagagtaggaaaggggccaaggngtacaacgtacttacccgaaccgggacccaacccccgaaccgaaaccaacgtacgtacgtacaacttggaaccaacgtacgaacgacgacccgtagaacgacgacgtacggaaccgaaccgtaccggtacccgtaccgttaacgtttaaccgttaggttacggaccggtaaggtaaacgttttcggttttaaccgttggttacgtaactttacggttaaaccttaagttttagttaacgttacgggtaacttacgttaagttcggtacggttacggtaaccggtttcggtaaccgggggg

SEQ ID NO: 339725 - DNA, 669 bp, Homo sapiens
  misc_feature: GZ8MTXP01CF17P.17.10.A10.1.454.CMB.2.raw
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctgccggcccccggacaggacggtcaccatctcttgctctacggaaccccccatgtgattcaattatgntctgtaccagcactcccggatccacgcccccaactcctcatatatagaanaataataacgcgaccctcgtacggggttcccctcgacgtattcctcgtcggcctccgaagtcctgggctacgtctcgccctaccgtcgggcctacgtccgaccggtcgacctccgacgtacggtacgggggacgacgggtcccgtaaggttacgtttccgtacggccgacctaaacgtacgtcggggtaacctttacccgacggtcccgtaggtaccgtttcgggttaacgggggttcggtttcgggaccgttagggttaccggggaaccttaaacgggttccgttaccgggtaaccccggttaccgtaacgggttacccgacgggttaccccgtaacgggttcccgttaacccccggg

SEQ ID NO: 339726 - DNA, 641 bp, Homo sapiens
  misc_feature: GZ8MTXP01DV0FH.17.10.A10.1.454.CMB.2.raw
  modified_base (253)..(253): a, c, t, g, unknown or other
  misc_feature (253)..(253): n is a, c, g, or t
  modified_base (481)..(481): a, c, t, g, unknown or other
  misc_feature (481)..(481): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtacccacgcccaggttcagttggtgcagactgggctgaggtgcagagcctgggcatcagtgactgtctcctgcaaggccagtgatatatcttacaacaaatntgtatgaagtgggtagcgacgacggcccccggagaacggtcttggaggtggggtggggtggtcgaggcggtcgtttaggacgggttaaggcgatagtagtgaccgaaccgaggagtaggaacggcgaaaggtacgtcgaacgtaaccttaaacccgaccggaccccaaacccccgaagaaaccacgtagttacctaacagtcgaaccaaacgtgaacgagccttaagngaagcgacggtacggacgacgcccggtattacgttacgttcgtagtacgtagtaaagtttcgtttcttaacgttcgttacgttccgttaaagttaacgtttagttacgttggttactcttagttggtacgtcggttacgttccgttggggtaacccgggg

SEQ ID NO: 339727 - DNA, 654 bp, Homo sapiens
  misc_feature: GZ8MTXP01AV3P8.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggcagtgatatatcttacacaaatatgtatgaagttgggtgcgacgacggcccccggagaagggtcttggaggtggggtgggggtgggtcgaggtcggtcgtttaggacgggttaaggcacgtagtagtgaccgaccggaagacgtaggaagggacagtcgtacgaacgacttaccgaccggaacccacccccgaaacgaaccacgtacggtactacacgtacgacctaacgtacggaacgacgaccgtaggagacgcggtagaccgaccgacgggccttacgtacgttacgtcgtagtacgtagttagtttgttttcgttcgttacgtacttacggttaaacttaatttcggttaagttacgggtaaccttacgttaaggtacgggtacgttacgggtaaccgttttcggggtaaccgggggg

SEQ ID NO: 339728 - DNA, 560 bp, Homo sapiens
  misc_feature: GZ8MTXP01CRVGN.17.10.A10.1.454.CMB.2.raw
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
  modified_base (413)..(413): a, c, t, g, unknown or other
  misc_feature (413)..(413): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccgganaagggcttgagtgggtggggtggtcagcggntttgacggtagcacagtatgccaccggaagatggaagggcagaagtcaacggacttacccgaacggaccacccccgaagaaccaacagtacanactggacaactgacgagccagagacgcgtacgacgacacggcctacgtattacgtgtgcgtaagtaacttgttttcgtgttctagttcgtaaactaatttagattagggctacttaagtggacttgggtaacgttcggtaacggggg

SEQ ID NO: 339729 - DNA, 700 bp, Homo sapiens
  misc_feature: GZ8MTXP01C90X7.17.10.A10.1.454.CMB.2.raw
  modified_base (364)..(364): a, c, t, g, unknown or other
  misc_feature (364)..(364): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaattgggtgcgacgacgggccccccggagaagggcttggaggtcggggcggggttcggggtcaggcggtacgtttggacggtaaggcacgaggttancgacccaccggaagacgtaggaaacggggcaaggaacgtacgaacgtaaacttaccccgaacgggaacccgaacccccccaaacgaaacctaactacggtaaccttaacgacttaggaccgaaacctgaacggaacgcccgtaggaaccgagacggttacggaaaccgaccgaaccgggtcccgttaccgtattaaccgttacggttcggcgggtaaataacgttttgttttaaccgttggttacccgtattacggtttaaacctaaagtttcgttagttaacggtctaaccgtttggtaccgggtagttcgggttaacctttcggggtccggggg

SEQ ID NO: 339730 - DNA, 715 bp, Homo sapiens
  misc_feature: GZ8MTXP01A2PYG.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgcaaggccagtggatatatcttacacaaaatatggtatagaagttaggtggcgacgaggcccccggaccgaagggacgtgtaggtgggtgggggtggggtcgagcggcgtttggtacggtaaggagacagtagtgccgacgaagagtagaagggaacgacgaagtacgacgacgttaccgaccgggaccaccccccgaacccggaaaccaaccgaacgtaccgttaacccaagttacgaccgaaccgttaggaaccggacgaccccgttaggaaggacgaccggttacggaaccggaaccgacccgggtaccccggttaccttaacgtttaccgtaggtttacggccggtaaaggtaaacgtttggtttttccgttcggttacgtacttacgggttaaaccttaaagttttagttaggttacggtaaccgttccgttaacgtttagggaccggtttacggggtaaccgtttttccggtaacccgggggg

SEQ ID NO: 339731 - DNA, 679 bp, Homo sapiens
  misc_feature: GZ8MTXP01C8HVK.17.10.A10.1.454.CMB.2.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcaggaagccgtggggcatcagtgactgtctctgcaaggcagtgatatatcttanaacaaatatggtatgaagttgggtgcgacgacggcccccggagaagggcgttggaggtggggtggggtgggtcgaggcggtcgtttagggacggtaggcacgtagtagtgacccgaaccggaaagagtaggaaaggggtaccaaggtcgtacgaacgtaacgttaacccgaaccgggaacccaacccccgaacgaacacgaacgtacacagtacgactaaacgtcgaacggacgcgtaggagacggacgtaggaacccggtaacgcccgggtacccgttacgttacgttacgtacggtacgtaccggtaattaacgtttgttttaaccgtgttacttaacgttaccgttaaagttaagtttacgttaggttagtcccgtttacgtaagttacgggacgttacgggttaaccgttcggggtaacccggggg

SEQ ID NO: 339732 - DNA, 633 bp, Homo sapiens
  misc_feature: GZ8MTXP01DVYY7.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagagccgtggggcatcagtgactgtctcgtgcgaagccagtggtatatatcttacaacaaatgtagtatgaagttgggcgcgacgacgggacccccggagaagggtcttaggagggttggggtgggggtgggtcgagggtcggtcgttttagggaacgggtaaggctaacgagtagtcggaccgaaccggaaagagtaggaagggacaaggtcgtacaaacgtacttaccccgaacggaacccaaccccgaacgaaacacgtagtacaacagtacgaacctacacgacgacgccgagagacgcgtacggaccgacgaccggtccgtacttagtacgttcgcgtagtaggttaatttcgtttcgtgttactattaccggtaattaagttgattagggtcctagtgtcgtacgttggtaaccgttggtaaccggggg

SEQ ID NO: 339733 - DNA, 729 bp, Homo sapiens
  misc_feature: GZ8MTXP01CDZTS.17.10.A10.1.454.CMB.2.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (627)..(627): a, c, t, g, unknown or other
  misc_feature (627)..(627): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatcttanaactaaatntaggtatgaagttgggtgacgacgacggacccccggagaagggctttggaggtgggggtgggggtgggtcgaggcgggtcgtttgggaacggtaaggcaactaggtacgtgaccccgaaccggaaggacgtagggaaaggggaccaaggtaacgtaccgaaacggtaacttaaccccgaaccgggaaccccaaccccccgaaacgaacctaacgacgttaccaacgatacgaaccgtaacgtaggacccgaggacccgtaggaacggacggtaccggtacggaacccgggaccgtaacccggggtacccttaccgttaacgtttaccgtggtacggtaccggaacgtttaagtttcgtttttaaccgnggttacttaacgttacggtttaaaccttagtttttaacggacgtttaggtccttacgttaagtcgggtaacgttcgggttaaccgtttcgggtaaccggggg

SEQ ID NO: 339734 - DNA, 714 bp, Homo sapiens
  misc_feature: GZ8MTXP01AFPEC.17.10.A10.1.454.CMB.2.raw
  modified_base (259)..(259): a, c, t, g, unknown or other
  misc_feature (259)..(259): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtcgtcgccggcccccggacaggaggtcaccatctctgctctacggaaccccctatgtgattcaattatgntctggtacagcaactccggatcacgaccccaaactcctcatatatagaagaataatacgacgtaccctcgacggggttccccaggtaccgtattcctacgtacgggtccctaaccgaacgtccgtcggggtacctaccgggttctaccgggacccctaaccccggttcggggaccctaacgtccccgaaccccgacccggtccgtacccgaacggtaccgggtacgggggaaccgacgggtacccggttagtttaacggtttccgtacggccggtacctaaaccgtcgttacggggtacctttacccgaaggtccccgttaggtaaccgtttcggggttcgggggtttcggttaccggggacccgttagggttaccggggaacccttaacggttcgttaccgggtaacccgtcggtaacggtcgaccggttacccgaacggttccgtcccccggg

SEQ ID NO: 339735 - DNA, 664 bp, Homo sapiens
  misc_feature: GZ8MTXP01A1O77.17.10.A10.1.454.CMB.2.raw
  modified_base (249)..(249): a, c, t, g, unknown or other
  misc_feature (249)..(249): n is a, c, g, or t
  modified_base (526)..(526): a, c, t, g, unknown or other
  misc_feature (526)..(526): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttanaacaaatatggtatgaagttgggtgcgacgacggcccccggagaacgggtcgttggagggtggggtgggggtgggtacgaggtcgggtgtttacgggaacggtaaggcaacgtagtagtcgaccgaccggaaagagtaggaagggacaggaacgtacgaacgtaacgttacccgaaccggacccaacccccgaagaacccaacgacgtacctacatacgacaactacggacgacgacctaggagacgcgtacgaccgacgacgtccgtctagttacnggtgacgtagtaaacgtttgtttccgttgttacgtacgttacgtaaacgtttaagtttcggttaagtttacggtaacccttacgttaaggttaccggggtacggttacgggttccggttcgggggttaacccgggggg

SEQ ID NO: 339736 - DNA, 638 bp, Homo sapiens
  misc_feature: GZ8MTXP01D4OVM.17.10.A10.1.454.CMB.2.raw
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (611)..(611): a, c, t, g, unknown or other
  misc_feature (611)..(611): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatcttacaactaaatatggtatagaagttgggcgacggacgaccgggacccccggaagtagggtctggagggttggggtgggggtggtcaggtcggtcgtttagggacggtaaggcaacgtagtagcgaccacggaagatagggaaggacgagtggtacacgtacgtaccgaccgggaaccaccccgaagaacagacgtctaanattacgacaacgtcggaacgntaccgngaaagcgtacggacggaaccggacgtaccgggtactaccgttataccggttaggttaccgacgtaagggttaactttcgtttaaccgtggttactacggttaccttaagtagtttcgaagttcgtaactgtaagtcgnttacgggttaacttggggtaaccgggg

SEQ ID NO: 339737 - DNA, 663 bp, Homo sapiens
  misc_feature: GZ8MTXP01DKWWU.17.10.A10.1.454.CMB.2.raw
  modified_base (325)..(325): a, c, t, g, unknown or other
  misc_feature (325)..(325): n is a, c, g, or t
  modified_base (389)..(389): a, c, t, g, unknown or other
  misc_feature (389)..(389): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctctgcaaggccagtggatatatcttacaacaaaatatggtatagaattgggtgcgacacgggcccccggacgaagggcttggaggtggggtgggggtgggtcnggcggtcgtttggacgggtaaggcacgagtagtgaccgaccgaagagtaggaacgggacgaagngtacacgtaacttacccgaaccggaacccaccccgaacgaaacacagtctaacatcgactaaacgtgacgaacgccgagagacgacgacgaaccggaccgaaccgggtccgtacgttaacttaccgttagtacgtaccggtagtaaacgtttgttttcgttcgttacgttaacgttacggttaaacctaagttttacgttaagttaacgggttccttacgttaagttcgggttaacgttacggggttaaccgtttccggggttaacccgggggg

SEQ ID NO: 339738 - DNA, 572 bp, Homo sapiens
  misc_feature: GZ8MTXP01C576I.17.10.A10.1.454.CMB.2.raw
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgacaggcagtggatatatcttacaactaaatagtggtatagaagttgggtgacgacgacggcccccggagaagggtcttggagggtggggtgggggtggtcgaggtcggtcgtttagggacggtaaggcacgtagtatcgaccgaccggaaagagtaggaaggacagcgtacacgtactaccgaccgaccaccccagacacagtcacatagacaactcgaacgacgccgtagagcgacgtacgaccgaccgcggtaccgttacttagttacgtgtcgtagtagtatttgtttctgttctagttcgtaatattgnttgtctatgtgtnttggtcgttcggtcgggg

SEQ ID NO: 339739 - DNA, 691 bp, Homo sapiens
  misc_feature: GZ8MTXP01A7NZK.17.10.A10.1.454.CMB.2.raw
  modified_base (394)..(394): a, c, t, g, unknown or other
  misc_feature (394)..(394): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagaagtcgtggggcatcagtgactgtctctgcaaggccagtggatatatcttacaactaaatatggtatgaagttgggtgcgacgacggcccccggagaagggcttggaggtggggtggggtggtcgaggccggtcgtttgggaacggtaaggcacgagtatcggaccgaccggaaagagtaggaaggggacaaggngtacaaacgtactaacccgacggaaccccaacccccgaagaaccacacgtactaacgatacgacaacgtcggaacgacgaccgtaggaacgtacggaccggtacggaaacccggtaacccgaccgggtacccgtttaacgttaacgtttacttacggggtcgtaaccggtaagttaaagtttcgttttaacgtcggttacctaaagttcccggtttaaaactaagtttttacgacggttaacgttcccgtagttaacggttcgggtacgttacgggttccgttcgggtaaccggggg

SEQ ID NO: 339740 - DNA, 602 bp, Homo sapiens
  misc_feature: GZ8MTXP01DA95O.17.10.A10.1.454.CMB.2.raw
  modified_base (314)..(314): a, c, t, g, unknown or other
  misc_feature (314)..(314): n is a, c, g, or t
  modified_base (551)..(551): a, c, t, g, unknown or other
  misc_feature (551)..(551): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccgagaaggcttgaggtgggtggggtgggtnagcggtctttggacggtaaggtcacgagtatcgaccgaaccgaagagtaggaaggacagaagtacgaacgacttaacccgacggacacccccgaacgaactacaaggttacacatacgacaaactgaacgagtccgagagtacgacgtacggaccgacgtaccggccgtccgtattaccgtgtgacgtagtaacgtttgttttcgtgttacctaggttacttaaacgtaattttagngttaggtaacttacgtaagtacggccttagggtaacgttccggtaaggggg

SEQ ID NO: 339741 - DNA, 655 bp, Homo sapiens
  misc_feature: GZ8MTXP01CBYTU.17.10.A10.1.454.CMB.2.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtacccacgcccaggttcagttggtgcagactggggctgaggtgcagaagccgtgggcatcagtgactgtctcctgcaaggcagtgatatatctacaanaaatntggtatgaatgggtncgacgacggccccgganagggcttgaggtggggtgggtggtcaggcggtgtttaggacggtaaggcacgagtatgacaaccccggaagagtaggaaaggcaaaggacgtcgaacgtaacgttaacccgaaccgggaacccaaccccccgaaacggaaaccaacgaacgtaccttaacgagtacgacgaaacgtacggaaccgagccgaagaggaacgtcgtacggacgaaccgacgaccggtacttacgttaacgtgttacgtcggtaagtacgttcttttcgttcttcggttacttaccgttaagttaaacgtttagttagttacgttacgttaacgtagttaacggttacgtacggttacggttcggttcgggtaacccggggg

SEQ ID NO: 339742 - DNA, 772 bp, Homo sapiens
  misc_feature: GZ8MTXP01D1772.17.10.A10.1.454.CMB.2.raw
  modified_base (250)..(250): a, c, t, g, unknown or other
  misc_feature (250)..(250): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatcttanaactaaatgtggtatgaagttgggtcgcgacgacggcccccggagaagggtcttggaggtgggggtgggggtgggtcgaaggtcgggtacgttttcgggaacgggttaagggctaacgtaagtacgtacggacccgaccggaaagagtaggggaaagggaccgaagtaacgggtaccgaaaccgtaaacgttaaaccccgaaccgggaaccccgtaaaccccccgaaaggaaacccaacgtaacggtacctaacgaagttcgaacgtaaaccgtaggaacccgagttacccgtaggaacgacgaccggtaaggaacccgaaccggtaacccggggtacttaacccgtaagtttaccgtaggttacgaccggttaaagttaacgtttcgtttttaacgtggttacccgtaagtttacccgttaaacgttaaagttttaccggaagtttaacccggggtttctttaacgttaacggttacgggttacggttcgggttaacccgggtttcgggggtaacccgggg

SEQ ID NO: 339743 - DNA, 659 bp, Homo sapiens
  misc_feature: GZ8MTXP01CSIOQ.17.10.A10.1.454.CMB.2.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatctanaacaaatntggtatgaattgggtgcgacgacggccccggagaaggcttggaggtggggtggggtgggtcaggtcggtctttgggaacggtaaggcacgagtagtgacccgaaccggagagtaggaagggacaaggaagtcgaaaccggtacttaacccgaccgggaacccaaccccccgaacgaaaccacgacgtacctacacgtacgaactaacgtacggaacgacgacctaggacgacggacgtacggaaccgaaccgaccgggtcccgttacttagttacgtcggtacggtaccgtaagttaactttgttttcgtacgttctaacgttcggttaaacttagttttacgagttacgggtccttacgtcgttagggtacgttacggtaaccggtttcgggtaaccggggg

SEQ ID NO: 339744 - DNA, 665 bp, Homo sapiens
  misc_feature: GZ8MTXP01AR73M.17.10.A10.1.454.CMB.2.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatcttacaanaaatgtggtatgaagttgggncgacgacggccccggagagggcttggaggtggggtgggggtggtcgaggtcggtcgtttagggaacgggtaggcacgtagtagtcgacccgacggaagagtaggaagggacagcgtcgaacgtacttacccgaaccgggacccaacccccgaacgaaccacgtacgttacctaacgacgtacgaactaacgtcgaacgacgccgtagacggacgtcggacggaaccgaaccgtacgggtccggttacttacgttaccgtaggtaccggacgtaaggttaagtttcgtttccgtgttacccgtaagtttacgtaaacgttaagtttaggacgttacgtaacgtttcgtaacgttcggtacgttacgggtaaccgttttcgggtaacccggggg

SEQ ID NO: 339745 - DNA, 634 bp, Homo sapiens
  misc_feature: GZ8MTXP01A8XY0.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaatntggtatgaattgggtgcgacgacggcccccggagaagggcttggaggtggggtgggggtgggtcgaggcggtcgtttggacggtaaggcacgagtatgaccaccggaagagtggaagggcaggaagtcaacgacttacccgacgggaccacccccgaagaaccacgagtactaacatcgacaaactgaacgagccctaggaacgagcgtacggaaccgaccgaccgggtccgtactacgtttacgtggtcgacgtaaggtaactttggttttaactggttacacgttacgttaaacgttaagtttcggagttacgggtaaccttacgttaaggtcgggtaaccgttcgggttaaccgttttcggggtaaccgggggg

SEQ ID NO: 339746 - DNA, 701 bp, Homo sapiens
  misc_feature: GZ8MTXP01AD5FY.17.10.A10.1.454.CMB.2.raw
  modified_base (259)..(259): a, c, t, g, unknown or other
  misc_feature (259)..(259): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaactaaatntggtatgaattgggtgacgacgacggcccccggagaagggcttggagggtggggtggggtggtcgaggcggtgtttaggaacgggttaaggctacgtagtacgtcggacccaaccggtaaagagtacgggaaaggacaaaggcggtacaaaccggtaacttaaccccggaacgggaaccccaaccccccgaagaaaccacgacgttacaacagttcgaacaacgtagaaccgagacccgtagaacgacgacgtacggaaccgaaccgaccgggtccgtacgttaacgttaccgtagggtccgtaggtaaggttaactttcggttttaactacgggttacctaacgtttacccggtaaactttaacggtttagacgtttacgggtccttacgttaacggttcgggtaacgttcggggtaaccgtttccggggtaaccgggggg

SEQ ID NO: 339747 - DNA, 706 bp, Homo sapiens
  misc_feature: GZ8MTXP01B5VE3.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtgatatatcttacaacaaatatggtatagaagttgggtgcgacgacggcccccggagaagggtcttggaggtgggggtgggggtggtcgaggtcggtctttagggacgggttaaggcacgtaggtatcggacccaaccggaaagagtagggaaacggggtcaaggtcgtaccgaacggtacttaaccccgaaccgggaccccaaaccccccgaacggaaaccacgtaacgtactaacagttcgaaacctaacgtcggaaccgacgacccgtaggaacgacgaccggtacggaaccggaaccgaccgggtcccggtacttacgttaccgtgggtacgtcggtaagttaacgtttggttttaaccctagtttaccctaacggtttacgttaaacgttaagttttaggacgttacgggtctacgttaacggttcgggtaacgttcgggtaacgtttccgggtaaccgggggg

SEQ ID NO: 339748 - DNA, 610 bp, Homo sapiens
  misc_feature: GZ8MTXP01DC80S.17.10.A10.1.454.CMB.2.raw
  modified_base (285)..(285): a, c, t, g, unknown or other
  misc_feature (285)..(285): n is a, c, g, or t
  modified_base (379)..(379): a, c, t, g, unknown or other
  misc_feature (379)..(379): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggcagtgatatatcttcacaaatatggtatgaatgggtgcgacgaggcccccganaagggcttggaggtggggtgggggtggtcgaggtcggtcgtttaggacgggtaaggctacgaggtatgaccaccggaagagtaggaagggcagngtcgaacgtacttaacccgacggacccaaccccgaaacgaacacacgtacacatgaaccgaactcgacgacgccgtaggagacgcggtacgacgaccgacggtccgtacttagtttaccgtaggtcgtacgtaagttacttgttttctgttactatttcgtaacttaagtttcggttattacggtcttacggtaacgttagggccttagggtaaccgttcggtccgggggg

SEQ ID NO: 339749 - DNA, 615 bp, Homo sapiens
  misc_feature: GZ8MTXP01EIC1M.17.10.A10.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (455)..(455): a, c, t, g, unknown or other
  misc_feature (455)..(455): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtacagagccgtgggcatcagtgactgtctcctgcaagcagtgatatatctacaanaaatntgtatgaagtggngcgacgacggcccccggagaaggtcttggaggtggggtggggtggcgaggtcggtcgtttaggaacgggtaagcgtacgagtagtcgacgaacccggaagtagtagggacggacaaagggacgtcgaacgtacgtacccgaccggaacccaccccgaagacacagtactacatcgacaacgtgaacncgtccgagagtagcgtacggggaacgaccggtaccgtccgtataacgtacgtggtaccgtagtagttagttcgtttcgaagttcacgttacgttaagttagttgaagttacgttcttaagtacgtggtcgttggttaccgtttcgggcgggtaacccggg

SEQ ID NO: 339750 - DNA, 662 bp, Homo sapiens
  misc_feature: GZ8MTXP01AXXZG.17.10.A10.1.454.CMB.2.raw
  modified_base (254)..(254): a, c, t, g, unknown or other
  misc_feature (254)..(254): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (530)..(530): a, c, t, g, unknown or other
  misc_feature (530)..(530): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtggggctggaggtgcagaagccgtggggcatcagtgactgtctctgcaaggcagtgatatatcttacaanaaaatagtggtatgaagttgggtgcgacgacggcccccggaagaagggtcgtttggaggggtggggtagggggtgggtacgaggcgggtacgttttgggaacggtaagggtcaacgaggttancggacccaacggaagagtaggaaggggacaggngtcaacgacttacccgacgggaaccacccccgaagaacacacgttacacatcgactaacgacgacgacgtccgagagacgcggtagaaccggaccgaaccgggtccctgttaagttccgnggttagcgtaagttaaagtttgttttaaccgtaggttctaacgttaccgttaaagtaagttttacggaaattcgggtaaccctttgtaacgtcggggtacttacgggttaacgtttccgggtaaccgggggg

SEQ ID NO: 339751 - DNA, 714 bp, Homo sapiens
  misc_feature: GZ8MTXP01AXHAG.17.10.A10.1.454.CMB.2.raw
  modified_base (580)..(580): a, c, t, g, unknown or other
  misc_feature (580)..(580): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcgagaagccgtggggcatcagtgactgtctccgtgacaaggccagtggatatatcttacaacaaatagtggtatagaagttgggtcgacgacgacggacccccggagaacgggtcgttggagggtggggtgggggtgggtcgaggcggtcgtttaggacgggtaaggctacgagtatcggacccgaacggagagtaggaagggaacaggtaagtacaacgaacttacccgacggaacccaaccccgaacgaacaaccgtaagtacctaaccgtacttacaaaccgtcgaacacggacctaggacgacgacgtacgggaacggaccggtaccggtcccgttacgtaactttacgtagtacgaccggtaagttaagtttcggtttanaacggttacttagtttacccggttaaatttaacgtttagttaaacggtttcgggacctttaacggttaacggttaacgggtaccggttacgggttaacccggtttcgggggttaaccggggggtaaccccgggg

SEQ ID NO: 339752 - DNA, 624 bp, Homo sapiens
  misc_feature: GZ8MTXP01B9NJG.17.10.A10.1.454.CMB.2.raw
  modified_base (254)..(254): a, c, t, g, unknown or other
  misc_feature (254)..(254): n is a, c, g, or t
  modified_base (380)..(380): a, c, t, g, unknown or other
  misc_feature (380)..(380): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaatntggtatgaattgggtgcgacacggcccccggagaagggcttggaggtggggtgggggtgggtcgaggtcgggtcgtttggacggtaaggcacgagtatgaccaccggaagagtggaagggcaaggngtcacgattaccgacggaccacccccgagaaccacacgtactacatgacaacgtgacgagcctgagacgcgtaggaaccgtaccgacgggtcccgttctacgttacgtcggtcgtaccggtaagtaacgtttggttttctcggttactacgtttaccgttaaacgttaagttttggacttacgggtccttacgttaaggttcgggtaccgttacggggtaacccgtttcgggtaacccgggggg

SEQ ID NO: 339753 - DNA, 634 bp, Homo sapiens
  misc_feature: GZ8MTXP01EBZGW.17.10.A10.1.454.CMB.2.raw
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (577)..(577): a, c, t, g, unknown or other
  misc_feature (577)..(577): n is a, c, g, or t
  modified_base (608)..(608): a, c, t, g, unknown or other
  misc_feature (608)..(608): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgacaaggcagtgatatatcttacaacaaatntggtatgaagttgggncgacgacggcccccgagaggtctggaggtggggtggggtggtcaggtcggtcgtttagggaacggtaaggcacgagtagtcgaccccgaacggaagagtagggaaacgggacgaaggtcgtaccaacggtaaccttaaccccgaaccgggaaccccaaacccccgaaacgaaaccaacgtacgttacaacgtatacgaaccgtaaacgtcgaacggacgacctaggaacgacgtcggaacgaccgaccgaccggtcctacttaagtttaccgaggttcgagtaagttactttggttttaacngttctattacgttaatagtttgattggcttngtgacgttgtaacgttggaaccgggg

SEQ ID NO: 339754 - DNA, 633 bp, Homo sapiens
  misc_feature: GZ8MTXP01DJ1PJ.17.10.A10.1.454.CMB.2.raw
  modified_base (373)..(373): a, c, t, g, unknown or other
  misc_feature (373)..(373): n is a, c, g, or t
  modified_base (548)..(548): a, c, t, g, unknown or other
  misc_feature (548)..(548): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcaggaagccgtggggcatcagtgactgtctcctgcaaggccagtggatatatcttacaacaaaatatggtaatgaaattgggtgacgacacgggcccccggacgaagggctttggagggttggggtgggggtgggtcgaggtcggtcgttttagggaacgggttaaggcacgagttangccacgtagaagagtaggaaaagggcaagagtacgaaacgacttacccgacgggacccacccccgaacgaacacagtacctacatagaccaacgtgaacgagccgtagacgaggcgtacgacgacgacggcccgtcttataacgtcgtagacggtagtaagtttcggttttaccnggttacagtttaccgtaacgttaagttttcggaagttcgggtacttcgttagtacgggttacgtcgggttaacgtttcccggggg

SEQ ID NO: 339755 - DNA, 619 bp, Homo sapiens
  misc_feature: GZ8MTXP01BUIUR.17.10.A10.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
  modified_base (385)..(385): a, c, t, g, unknown or other
  misc_feature (385)..(385): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtgatatatctnacaaatntgtatgaattgggtgcgacgacggcccccgganaagggcttggaggtggggtgggggtgggtcgaggtcggtcgttttaggacggttaagggcaacgtaggtatgaccgaccggaagagtagaagggacagngtacacgattacccgacggaccacccccgaagaacacagtctacatacgacaacgtgacgagcctagagagcgtggaaccgaccgacggtccgtacgtaacgttaccgtaggtcgtaccggtaagtacgtttgttttcgtcgttacgtacttccgttaaacctaagttttcgagtttacggggaacttcgtaagttcgggtacgttggttaaccgtttcggggtaacccggggg

SEQ ID NO: 339756 - DNA, 731 bp, Homo sapiens
  misc_feature: GZ8MTXP01DKF1Y.17.10.A10.1.454.CMB.2.raw
  modified_base (272)..(272): a, c, t, g, unknown or other
  misc_feature (272)..(272): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggcagtgatatatcttacaacaaatatggtatgaagttgggngcgacacggccccggagaagggcttggaggtggggtgggggtggtcgaggtcggtcgtttgggaacgggtaggcgaacgagtatcggacccaccggaaagagtaggaaacggggtccaaggtaacggttaccaaccggtaaaccgttttaaacccccggaaaccgggaaccccgaaccccccccgaaacgggaaaccctaaccgtaacggttaccctaaccgtaacgttacgaaacccgtaaaccgttacggaaccggaaacggtccccgttaagggaaacggacggtcgggttaacgggaacccggaacccgtaccgggtacccggttacttacgtttaccgtgtacggtaccgtaagttagtttacggttttctggttactacgttacggtaacttaagtttcggattacgggtccttagtaagtcggtacgttaggtaacgttcgggtaacggggg

SEQ ID NO: 339757 - DNA, 648 bp, Homo sapiens
  misc_feature: GZ8MTXP01A8910.17.10.A10.1.454.CMB.2.raw
  modified_base (260)..(260): a, c, t, g, unknown or other
  misc_feature (260)..(260): n is a, c, g, or t
  modified_base (392)..(392): a, c, t, g, unknown or other
  misc_feature (392)..(392): n is a, c, g, or t
  modified_base (525)..(525): a, c, t, g, unknown or other
  misc_feature (525)..(525): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggcagtgatatatcttacaactaaatntggtatggaattgggtgcgacgacgggcccccggagaagggcttaggagggtggggtgggggtgggtcgaggcggtcgtttgggacggtaaggcacgtagtagtgacccgacggaagagtaggagggacagngtacaacgtactaccgaccgggaacccacccccgaacgaaccaacgtacgtactacgactcgaaccaacgtacgaaccggacgcccgtaggacgacgcggtacggaccgacgaccggtccgtactagttacgnggttgcgtaagtaacgtttcgtttaacgtcggttactaacgtttaccggttaaattaagtttacgttgttacgggtcttagtaagtaggtacgttacggttaaccgtttcgggtaaccggggg

SEQ ID NO: 339758 - DNA, 869 bp, Homo sapiens
  misc_feature: GZ8MTXP01DPVUH.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacaactaaaatatggtaatgaaagttggggtgcgaacgacgggaccccccggaacgaagggtccgtttaggagggttgggggttgggggtgggggtcaaggtcgggtcgttttgggaacgggtaaagggcgaaccgtaggtatcggaccgacccggtaaaaggattaggggaaggggaacctaagggaacggttaccaaacccggggtaaactttaaaccccccggaaacccgggggaaccccaaacccccccccgtaaacgggaaaacccctaacgtaacggttacccttaaacgaacttaacggaacccgtaaaaccgttcggaaacccgggacgtaccccgtgggaaacgaccggttacgtaccgggaaacccggtaaaccgaaccccgggggtccccgttaactttaacggttttaaacccgtcggggtttaggaccggtaaacggttaaactttttggggtttttaacctacggggttttaacccttaaagggtttaaccgttaaaccctttaaaaggtttttcggttaaagtttaaacggggtcccttacgtttaacgtttagggggaacccgtttggggtaaaccccgtttttcggggtaaccccggggggggg

SEQ ID NO: 339759 - DNA, 680 bp, Homo sapiens
  misc_feature: GZ8MTXP01C12Z3.17.10.A10.1.454.CMB.2.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (474)..(474): a, c, t, g, unknown or other
  misc_feature (474)..(474): n is a, c, g, or t
  modified_base (581)..(581): a, c, t, g, unknown or other
  misc_feature (581)..(581): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaaggccagtgatatatctanaanaaatntggtatgaatgggtncgacacggcccccggagaagggtcttggaggtggggtgggggtgggtcaggcggtcgtttagggaacggtaaggcaacgagtagtcgaccccgacggaagagtaggaacgggacaggaacggtacaacggtactaacccgaccggacccaacccccgaaggtaaaccacgtacggtacctaacgacgttacgactaaacgnggaacgacgccctaggaacgacgtacgtacggaaccggaaccgaccggggtacccttattaacgttaccggtgttacgaccggtaaggttaacttcgggttttttcncggttactaacgttacggttaaactaagttttcggagtttacgggccctttataaggtcggtaacgttcggggtaaccgttttcgggggaacccggggg

SEQ ID NO: 339760 - DNA, 646 bp, Homo sapiens
  misc_feature: GZ8MTXP01ATFYJ.17.10.A10.1.454.CMB.2.raw
  modified_base (250)..(250): a, c, t, g, unknown or other
  misc_feature (250)..(250): n is a, c, g, or t
  modified_base (423)..(423): a, c, t, g, unknown or other
  misc_feature (423)..(423): n is a, c, g, or t
  modified_base (532)..(532): a, c, t, g, unknown or other
  misc_feature (532)..(532): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttanaacaaaatatggtatgaattgggtgcgacgacggcccccggagaagggtcttggaggtgggggtgggggtgggtcgaggcgggtacgtttaaacgggtaaggcacgagtatgacaccccggaagagtgaagggcaagagtcacgattacccgacggaccaccccaacgaacanagtacacatcgacaaacgtgaacgacgacctagacgagcctaggggacgaacgaccacggtccctacgtattaccgtagtcgtacgtaaggttaacttcgggtttttcncgtttacgtaacgttacgggttaaaccttaagttttacgttaaggttaaccgttccgttacgttaaggttgggtaacccgtttagggtaaccgtttttcgggaaccccgggggg

SEQ ID NO: 339761 - DNA, 689 bp, Homo sapiens
  misc_feature: GZ8MTXP01AVVJY.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaactaaaatatggtatgaagttgggtagcgacgacgggcccccggagaagggcttggaggtgggggtgggggtgggtcgaggtcgggtctttagggaacgggtaaggctaacgagtatcggaccaaccggaaagagtaggaaagggccaaggcgtacgaaccgacttaaccccgacggggaacccaacccccgaaacgaaccaacgacggttacaacgtactacggacaaaccgtagaccggacgtaccgtggaagacggttaccggtacggaacccggaccgtaacccggggtccgttaacttagtttaccgtggtacggtaccggttaaagttaacgtttgttttcgtcggttacctagttaaccgttaactaaagttttgaagttagggtctcttaacgtgggtaacttcgggttaaccgttcgggtaaccggggg

SEQ ID NO: 339762 - DNA, 674 bp, Homo sapiens
  misc_feature: GZ8MTXP01COS6Q.17.10.A10.1.454.CMB.2.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
tcagcgtagactagcacgaccggtgctcgattttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgacaaggcagtgatatatctnaanaatntgtangagtggtgcgacgacggccccggagaggtcgttggnggttggggtgggggtgggtcgaggtcgggtcgtttagggaacgggtaaggcacgtaggtatgacccgaaccggaaagtagtaagggaacgggtacaaggtgtacaaacgaacgttacccgaacggaccccaacccccgaaacgaaccacgtacgtaccgtacatacgaacaacgtacgaccgtagaccgtaggaacgacgcggtacggaacgtaccgaccggtccgttactaacgttaccgtaggtgaaccggtaagttaagtttcgtttaacgtgttacgttacgttccggtaaatttaagtttacggttacgttacgggttaacttcggttaaggttcggtaacgttcgggtttaacgttcggggtaaccggggg

SEQ ID NO: 339763 - DNA, 637 bp, Homo sapiens
  misc_feature: GZ8MTXP01ENKF8.17.10.A10.1.454.CMB.2.raw
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtcctcctgcaaggccagtgatatatcttacaanaaatntaggttatgaagttgggngcgacgacgggacccccgagaagggtcgttggaggtggggtgggggnggtcgaggcggtgtttaggacggtaggcacgagtatcgccaaccgaagagtagaaggcagngtcgaaacgtactacccgaacggacccacccctaacgaacactacgacacatcgacaacgtgacgacncctaggacgacgcggtacgaaccggaacgaccggtaccgttacgtaaacgttccggtagtcgtaccggtaagttaattttcggttttaacccgtagttaccgttacgttaccgttaaacgttaagtttagttagttacggtaacctgttaacgtggtacgttcggtaacgttcgggtaaccggggg

SEQ ID NO: 339764 - DNA, 643 bp, Homo sapiens
  misc_feature: GZ8MTXP01ETENJ.17.10.A10.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (593)..(593): a, c, t, g, unknown or other
  misc_feature (593)..(593): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaagcagtgatatatctacaanaaatntgtatgaattggtncgacacggccccgagaggcttgaggtgggtggggtgcaggcggtgtttggaacggtaagcacgagtagtgacccaacggaagtagtaggaagggacagaacgtcgaacgtaacttacccgaccgggaacccaaccccgtaaacgaacactacggtactacatcgaacctaacgtcgaacgacgacccgtaggaacgacgtaccgtacggaacccggaaccgaccggggtacctaccgttaacgttaaccgtggttcgaacggtaagttaaacgttttcgggttttaacctggttacctaattaccggttaaataagtttacgnttacggtctagttaacgtaggtacgttggtaacgtttcgggaaccggggg

SEQ ID NO: 339765 - DNA, 688 bp, Homo sapiens
  misc_feature: GZ8MTXP01AY088.17.10.A10.1.454.CMB.2.raw
  modified_base (207)..(207): a, c, t, g, unknown or other
  misc_feature (207)..(207): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcgccggcccccgganaggacgtcaccatctctgctctaccggaaacccccatgttgattcaattatgtcgtcctaggtaccacgccaaccgtcccggataccaccgacccccaaactcctactactaatacgtagaaagtaataaacgtaacgaccgtaaccctacggtacggggttcccctacggtaccgtacttccgtcgtacgggtccttccgaaacgtcgtcggcctacgtctcgcccacccgtgggacctactccgaacccgcgtaccctaccgagtaccggcggggaacgacgggaccgttagttacgtttcgcggtaccgaacctaacgagttcggggtaccttaccgaacgtcccgtaagttccggtttcggtcgggggtttcgtttccgggacgttacggggttaccggaaccgaacggttcgttaccggtaaccccgtcgttaacgggacccacggttaccccgtaacgggttcccgttcccccgg

SEQ ID NO: 339766 - DNA, 628 bp, Homo sapiens
  misc_feature: GZ8MTXP01DW1KV.17.10.A10.1.454.CMB.2.raw
  modified_base (398)..(398): a, c, t, g, unknown or other
  misc_feature (398)..(398): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaggcagtgatatatcttacaactaaatatggtatagaagttgggtgacgacgacgggaccccggagaagggtcgttggagggtggggtgggggtggtacgaggtcggtcgtttagggaacggttaacggacaacgtagtagtcgaccgacggaagagtaggaggacagngtacacgactacccgaaccgaccaccccgaacgaacactacgtacacatacgactaacgtacgacgacgaccgtagagtacgacggacgaccgaccgaccggtacttacgtacgttacgtgtcgtacgtagttaacgtttgtttctgttacttacgttacgttaacgttagtttagttagttacgtcttagtaagttcggtacgttacggttcggttcggtaaccggggg

SEQ ID NO: 339767 - DNA, 607 bp, Homo sapiens
  misc_feature: GZ8MTXP01AHVNK.17.10.A10.1.454.CMB.2.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctccacccttctcattcactgcacagggtcctgggcccagtctgtgttgacacacgccgccctcagtgtctcgccggcccccgganaggagtcaccatctctgctctacggaaccccatgtgatcatntgtntctgtacagcactcggatcacgccccaactcncatatataganaataanagcgacctgtacggtccctagacgtattctcgtcgctccgaagtcgtggactcgtacncgaccctaccgtggctacgtccaccgcgacctcgacggtacggtacggggaccgacgggtccgtaagttacgtttcgaggccacgtaaacgtacggtcggtactttcccgaacgtccgtacggtaccgttcgggtaacggggttcgttaccgggcgttagggtaccgggaaccttacggttcttaccggaacccgttccggtaacgggtcccgaaccggacccgttaacggcccgttcccccggg

SEQ ID NO: 339768 - DNA, 701 bp, Homo sapiens
  misc_feature: GZ8MTXP01A7F0T.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaactaaaatatggtatgaagttgggtgcgacacggcccccggagaagggtcttggaggtgggggtgggggtgggtcgaggtccgggtcgttttagggaaccgggttaagggccaacgtaggtagtcggaccccgaaaccggaaagagtaggaaggggccaagggaacgtcaaacggtaacttaaccccgaacgggaacccaaaccccccgaacgaaaccaacgacggtactacaactcgaaccaaacgttggaaaccgagaccccttagacggtacgacgttacggaacgtaacccacgggtcccgttactaacgtttactaggttgaccggtaagttaacgtttggttttaacctagttcgtaaacgttcgttaaaccgttaattttgagttacggtccttagttaattacgggggtacttagggtaaccgtttcgggtaacccggggg

SEQ ID NO: 339769 - DNA, 747 bp, Homo sapiens
  misc_feature: GZ8MTXP01DI358.17.10.A10.1.454.CMB.2.raw
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (336)..(336): a, c, t, g, unknown or other
  misc_feature (336)..(336): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaaggcagtggatatatcttanaactaaatatggtatgaattgggngcgacgacggcccccggaagaagggtcttggagggtggggtgggggtggtcgaggtcgggtntttgggaaacgggtaggcacgtaggtatcgacccgaaccggaagagtaggaaacgggcgaaggaagtacaaaccggtaacttaacccgaacccgggaacccaacccccgtaaacgaaaccacgacgttaccaagtactgaaccgtaaacgttacggaaccggagttccccgagggaacgtacggtaccggtaacggaaccgggaaccgtaaccccgggtccggtttaaaccttacgtttaccggttaggtccggtaaggttaaggtaaacgtttttcggttttcctagggttacttacggttaaccgtttaaacgtttaaagtttgggttaacgttacgggttcctttaacggttaagttcgggggtaaacgtttccggggttaacgtttccgggggtttaacccgggggg

SEQ ID NO: 339770 - DNA, 653 bp, Homo sapiens
  misc_feature: GZ8MTXP01BTMLM.17.10.A10.1.454.CMB.2.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaagccgtggggcatcagtgactgtctcctgacaggccagtggatatatcttacaactaaatntggtatgaattgggtgcgacacggccccgagaggctggnggtgggtggggtgggtcaggtcgggtgttttagggaacgggttacggcacgtagtagtcgaccgtaccggaagacgtaggaacgggcaaggcgtacgaacgtacttaccccgaacggtaccccaaacccccgaagaaaccaacgtacggtacctacactacgaaccaacgtagaccgagcccgtagaaggacgacgtacggaacgaccgaccggtctaccgttattacgtcgtgtaccgtagtagtttggttttaactggttactacttacggttaacttagtttacggttattacgggtccttaggttaacgtcgggttacgttcgggtaacgtttcggggtaacccgggg

SEQ ID NO: 339771 - DNA, 636 bp, Homo sapiens
  misc_feature: GZ8MTXP01EP3S5.17.10.A10.1.454.CMB.2.raw
  modified_base (392)..(392): a, c, t, g, unknown or other
  misc_feature (392)..(392): n is a, c, g, or t
  modified_base (435)..(435): a, c, t, g, unknown or other
  misc_feature (435)..(435): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaatatggtatggaattgggtgcgacgacgggcccccggagaagggtcttaggagggtggggtgggggtgggtcaggtcggtcgtttgggacgggtaaggcacgaggtagtgaccgaccggaagataggaagggcaggngtacacgtaatacccgacggaccaccccacgacacgagtacanactgacaacgtgacgacgccagaacgagacgacggaaccgacgaccggccgtaccttaagttaccgtggtgaccggtaagtaaaccgttggttttaacctggttcctaactttaccggtaaactttaagtttacgttagttaacgggtcttaccgtaagttacgggtacgttacggggtaacctttcgggtaacccggggg

SEQ ID NO: 339772 - DNA, 651 bp, Homo sapiens
  misc_feature: GZ8MTXP01BCOP5.17.10.A10.1.454.CMB.2.raw
  modified_base (472)..(472): a, c, t, g, unknown or other
  misc_feature (472)..(472): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccggacaggaggtcaccatctcttgctctacgaacccccatgtgtattcaattatgtcgtctggtaccagcaaccgtcccggatccacgcccccaaactcctacatatatagaaagaataactaagccgaccctcgtacggggttccccctaggaccgtattcctcgtcggcctccgaagtctcggctacgtcgtcgccctacccgtggactactcgaccgcgacctaccgacggtacggtacggggacgtacgggccgtaagttcgtttacngggaccgaacgtaaccgtaggttacgggtacctttcccgaacgtccccgttaggtaccgtttcggtcgggggttcgttccggggccttaggggtacggggaacccttaacggggttcttaccgggaaccccgttcgtaacggtcacccgggacccctaaggggttcccctaaccccggg

SEQ ID NO: 339773 - DNA, 699 bp, Homo sapiens
  misc_feature: GZ8MTXP01C13M8.17.10.A10.1.454.CMB.2.raw
  modified_base (251)..(251): a, c, t, g, unknown or other
  misc_feature (251)..(251): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctctgcaaggccagtgatatatcttacaanaaatatggtaatgaagttgggtgcgacacgggcccccggagaagggcttggaggtggggtgggggtggtcaggcggtctttgggaacggtaaggctacgagtagtcgacccgaaccggaagacgtaggaaaggggaccaaggtaacgtaccgaacggtaaccttaacccgaaccggaaccccaacccccgaaacgtaaaccacgtacggtactaacgattacggacctaaacgtcgaaccggagccctggaaacggtcgacggtaacgggaaccgaaccgtaccggggtcctttacgtaatttccggtaaggtcgtaccgttaagttaacgttttcggttttaacctggttacttacgttaccgttaaacgttaattttaggacgtttaacggtccttacgttaaggtcgggtacgttacgggttccgtttcggggtaacccgggggg

SEQ ID NO: 339774 - DNA, 634 bp, Homo sapiens
  misc_feature: GZ8MTXP01AY61T.17.10.A10.1.454.CMB.2.raw
  modified_base (258)..(258): a, c, t, g, unknown or other
  misc_feature (258)..(258): n is a, c, g, or t
  modified_base (391)..(391): a, c, t, g, unknown or other
  misc_feature (391)..(391): n is a, c, g, or t
  modified_base (525)..(525): a, c, t, g, unknown or other
  misc_feature (525)..(525): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtggatatatcttacaacaaaatntggtatgaagttgggtgcgacgacggcccccggagaagggtctggaggtggggtgggggtggtcgaggcgggtcgtttggacggtaaggcacgtagtagtcgaccgaccggaagagtaggaaggggacaaggngtcaaccggtacttaacccgacggaacccaacccccgaagaaaccacgagtactaacgatggaccaacgtcggaacgacgaccgtaggaagacggcgtacggaaccggacgaccgggtccgtactagttaccgngtacgacgtataacgttcgttttctgttctagttaccgtaagttaatttggacttagggtccttagttaagtcgggtacgttacgggtaaccgtttcgggaaccggggg

SEQ ID NO: 339775 - DNA, 700 bp, Homo sapiens
  misc_feature: GZ8MTXP01BJPA5.17.10.A10.1.454.CMB.2.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (370)..(370): a, c, t, g, unknown or other
  misc_feature (370)..(370): n is a, c, g, or t
tcagcgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtgggtggtcagcggnttgacggtaagcacagtatgcaccgaagatggaagggcagagtcacgattaccacggaccaccccacgaacacagtctacatgacactgacgagcctagacgagctagaccgacgaacggcccgtctattaccgngttcgacgagtaaattcggttttctgttctaatcgttaactaaagttttagaacttaggtccttacgttagtacgggtaacgttacggtacgggtttacggtcgggggtacccgtaacgggggtaacccgtaacggggtcgtaacgttccgggttacctaccggtacttccgaaccggtaaccccgttaccccgaaccccggttaaaccggggcccccgtaaacggttccccgggtttaccccgtttcccccccgttccgggtaacccctaccccccgttcccgttaaccccgtaacggaccgtccccgttaaccccgtttccccggggg

SEQ ID NO: 339776 - DNA, 822 bp, Homo sapiens
  misc_feature: GZ8MTXP01BDBE9.17.10.A10.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctcctgacaaggccagtgatatatcttanaacaaatntggtatgaagttgggtgcgacacgggacccccggagaagggcgtttaggagggtgggggtgggggtcggggtacgagggtcgggtacgtttagggacgggttaaagggctaacgaggtacgtcggacccgaaccggaaagacgtagggaaaggggaccaaagggtaacgtaccgaaaccggtaaccgtttaaaccccgaacccggggaaacccccaaccccccgaaaacggaaaccctaaccgtaacggttaccctaacgtaacgttaacggttaaaccgttacgggaaacccggaacggtaccccgttaagggaacggtaacgggtcccgttaaacgggggaacccggtaaacccgggtaaccccggggttacccgtttaaccgttaaccgtttaaccggttaggtaccgggtaccggttaaagttaacgttttcgttttcgtaacgttaccgttagtttacccgttaaacgtttaagtttagttaacggttagggttcccttaagttacggttgggtaaccgttggggttaccggtttcggggttccgggggtaacccgggg

SEQ ID NO: 339777 - DNA, 637 bp, Homo sapiens
  misc_feature: GZ8MTXP01DBEN0.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacaacaaatatggtaatgaagttgggtgcgacacggcccccggagaagggtctggaggtggggtgggggtgggtcgaggtcgggtcttttacgggaggtaaggcacgtagtagtcggccaccggaaggtacgtagggaacgggccgaaggcgtacgaccgtaacttacccgaaccgggaccacccccgaacgaacacagttacacactagaccaactggaacgacgccgagagcgcggtacgaaccggaaccgaccggtcccgtacttacgttacgtgtcgtacgtagtacgttaggttttcctgttcgtaatttccggttaataagttttgaacgttacggtctttacgtaacgtggtaccttgggttaaccgtttcgggtccggggg

SEQ ID NO: 339778 - DNA, 688 bp, Homo sapiens
  misc_feature: GZ8MTXP01AM5L8.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcaggttggtgcagacgtggggctgaggtgcagaagccgtggggcatcagtgactgtctctgcaaggcagtgatatatcttacaacaaatagtagtatagaagttgggtgaccgacgaccgggcccccggaagagggtcgttggagggtggggtgggggtgggtcgaggtcggtcgtttagggaacggtaaggtcacgtagtatcggacccgaaccggaagtacgtaggggaacggactaagggaactacgaaacgggtacctaaaccccgaccggaaccccaacccccgtaaacggaaccaacgtaggttaccaacgattacgaccgtaaacgtcgaacggcgtaccgtaggaacggacgtacgggtaacggaccgaaaccggccggttcccgtacttaacgtccgtaggttacgacgggttatagttttcggtttcagttacacggtttactaagttaagtttcggacttagggtcccttagtaaggtacggtacttagggttcgttcggggaaccgggg

SEQ ID NO: 339779 - DNA, 566 bp, Homo sapiens
  misc_feature: GZ8MTXP01C1TCK.17.10.A10.1.454.CMB.2.raw
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggagaggcttggagtgggtggggtgggtcagcggctttggacggtaaggcacgagtatgaccaccggaaagagtggaaaggggccaggaacggtcaaccggtaagtttaacccgaccgggaaccaacccccccgaacggaaaccacaacggtactacactcgacaactgacgagcctgagagcgtgacgtacacggccgtctatacgtgtncgagattgtttcngttcattcgtaacatttgnttacggntactaagtgacgttggtaacgttcgtcgggg

SEQ ID NO: 339780 - DNA, 566 bp, Homo sapiens
  misc_feature: GZ8MTXP01E1P5H.17.10.A10.1.454.CMB.2.raw
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgaggcccccggacaagggcttggaggtggggtgggggtgggtcaggcggcgtttgacggtaaggcacngtatgccaccggagagtggaagggcagngtccacgattaccacggacacccccaacgaacacagtctacangccaactgacgagccctgacgagcgtgacgaccaccgggcccgttcgtattacgtgtgcggagtaattggtttaactgttcattcgtaactaattgagttacgggtctccgttaagtcgggtacttacgggtaacgtttcggtccgggggg

SEQ ID NO: 339781 - DNA, 574 bp, Homo sapiens
  misc_feature: GZ8MTXP01C92OZ.17.10.A10.1.454.CMB.2.raw
  modified_base (371)..(371): a, c, t, g, unknown or other
  misc_feature (371)..(371): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaagccagtgatatatctacacaaaatatggtatgaattgggtgcgacacggcccccggacaagggcttgaggtgggtgggggtggtcgagcggcgtttggacggtaaggcacgagtatgaccaccgaagatagaaggacagngtcacgatacacggacaccccagaacacagtctacatgacaactgaacgagccgagaagacgactagacgaaccgaccggccgttacctagtttaacctgtgtacggagtaaatttggttttaacttggacttaattcgttaaactaattttgattagggaacttagtaagttgggtatttgggtaacgtttcgggtcggggg

SEQ ID NO: 339782 - DNA, 606 bp, Homo sapiens
  misc_feature: GZ8MTXP01CDDZ4.17.10.A10.1.454.CMB.2.raw
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (530)..(530): a, c, t, g, unknown or other
  misc_feature (530)..(530): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaggcagtgatatatcttacaacaaatatggtatagaagttggtgacgacgacggccccggagaagggtcttggaggtggggtgggggtgggtcgaggcggtcgtttagggaacggtaaggcaacgagtagtcgaccgaaccggaagagtaggaagggacaggngtcaacgtactaccgaccgacccaaccccgaagaaccanacgtactanatcgacacgtgaacgacgccgtagagagcgtaggacgacgtaccggccgtactacgttacgtagtgtacgtaagttacgttggtttaacngttacgtattaccggttaatagttttagattacggtcttagtcgtggtaccgttggtaacgttcggtaaccggggg

SEQ ID NO: 339783 - DNA, 628 bp, Homo sapiens
  misc_feature: GZ8MTXP01COZFH.17.10.A10.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (543)..(543): a, c, t, g, unknown or other
  misc_feature (543)..(543): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggcagtgatatatcttacaanaaatntgtatgaagttgggtgcgacgacggcccccggagaagggtcttggagggtgggtgggggtggtcgaggtcgggtctttagggaacggtaggcacgagtagtcgaccgaacggaagngtaggaagggacaagngtacgaacgacttacccgaccggacccaaccccgaacgtaacacgtacgttacagactacggactaacgtgaacgagaccgagagacgtcgacgaaccggtacgaccgggtactacgtacgttagtcgttcgagtaacgttatttggtttcncgttacgtattaccggttaatagtttacgagttcggtaacttgttaagtcgggtacttcggttaaccgtttcgggtaaccggggg

SEQ ID NO: 339784 - DNA, 608 bp, Homo sapiens
  misc_feature: GZ8MTXP01BYERT.17.10.A10.1.454.CMB.2.raw
  modified_base (255)..(255): a, c, t, g, unknown or other
  misc_feature (255)..(255): n is a, c, g, or t
  modified_base (385)..(385): a, c, t, g, unknown or other
  misc_feature (385)..(385): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggcagtgatatatcttacacaaatntaggtatgaagttgggtgcgacgacggcccccggagaagggtcgttggagggtggggtgggggtgggtcgaggtcggtcgtttggacggtaggcacgagtagtgaccgacggtaagagtaggaaggcagngtcacgactaccgacggaccaccccgacgacacacgtcacagtgacacgcgacgacgccgtagacgacgcgtacggaaccgaccgacggtccgtacgttacgttacgtgtacggtacgtaagttactttgttttaacgtgttactagttacgttaactaagtttcggagttacgtcttagtaagttcgggacgttcgggtaaccgtttcgggtaacccggggg

SEQ ID NO: 339785 - DNA, 772 bp, Homo sapiens
  misc_feature: GZ8MTXP01BEM02.17.10.A10.1.454.CMB.2.raw
  modified_base (328)..(328): a, c, t, g, unknown or other
  misc_feature (328)..(328): n is a, c, g, or t
  modified_base (388)..(388): a, c, t, g, unknown or other
  misc_feature (388)..(388): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtgatatatcttacacaaaatatggtatgaattgggtgcgacgacggcccccggagaagggtcttggaggtggggtgggggtgggtcaggcggtntttgggacggtaaggcaacgagtatcgaccaccggtaagagtaggaaggggacaacgggngtaccgaacgtaacttaaccccgaaccgggaaaccccaacccccccgaaacggaaaccctaaacgtaaccggttacctaaacggtaacttacggaaccctaaaccgttacggaaccggaacgccccgttaggggaacggtaaccggtcggtacgggaaacccgggtaccgtacccggggtacccggttacttaacgtttacccggttaggtacggtaccgtaaacggttaggttttcgttttaacgttacgggttactaaacgtttcccgggtaaactttaaacgttttcgggttaagtttacggggtaaccctttacggttaaggttaacgggttaccggttacggggtttaacccggttttcccggggtaacccgggggggg

SEQ ID NO: 339786 - DNA, 633 bp, Homo sapiens
  misc_feature: GZ8MTXP01ELPT8.17.10.A10.1.454.CMB.2.raw
  modified_base (260)..(260): a, c, t, g, unknown or other
  misc_feature (260)..(260): n is a, c, g, or t
  modified_base (340)..(340): a, c, t, g, unknown or other
  misc_feature (340)..(340): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcgccggcccccggacgaggagtcaccatctctgctctacgaacccccctaatgtgatcaattatgtntctggtaccagccaacgtccggatcacgccccaactctcatatacagaagataaacgtagacaccgtcgtacggttcccncgacgtattctcgtacgctccgaagtccgtggcctacgtccgtcgaccctaccgtgggtccacgccaccgcgtacctaccgagaccggtacggggacgacggtacgtacgttagttcgtcggccgacaaccgtgtacgggtacttaacccgcgtccgttacggtacgtttccgggtgggggttcggtttccgggcgttaacgggttacgggggaacccttaagggttccgttacggtaaccccgttacgttaacggtccgaacggacccgtaacgggttcccgttcccccggg

SEQ ID NO: 339787 - DNA, 653 bp, Homo sapiens
  misc_feature: GZ8MTXP01EJPMV.17.10.A10.1.454.CMB.2.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (319)..(319): a, c, t, g, unknown or other
  misc_feature (319)..(319): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggcagtgatatatcttacaactaaatntggtatggaagttgggngcgacgcggccccggagagggctggaggtgggtggggtggtnaggtcggtgtttagggaacggtagcgactagtatggacccaacggaagagtagggaacggggacaaggtcgtacgaacgtaaccgttaacccgaccgggaaaccctacccccgaaagaaaccacgacggttacaacatacggaacctaaacgtgaaccgngacccgtaggaacgtacgcgtaggaaccgaaccgtccgggacccgttattacgttacgtcggtgacggtacgtaatttcggtttaactggttacctgtttaacggtacttaagtttggattacgggtcttacgtgtacggggtacgttggtaacccgtttggggaacccggggg

SEQ ID NO: 339788 - DNA, 803 bp, Homo sapiens
  misc_feature: GZ8MTXP01C57KF.17.10.A10.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggcagtgatatatcttanacaaatntgtangaagtgggtgcgacgacgggcccccgagaaggtcttaggagggtcggggtgggggtgggtacgaggtacgggtcgttttagggaacggggtaacggtcaaccgtaggtagtcggaccgacccggaaaggtagtaggggaaacggggaccaaggtcggtactaaccgggtaacctttaaccccggaacccgggaacccccgaaaccccccgtaaaccgggaaacccctaacgtaaaccggttactaaccgtaacgttacgaaaccgtaaccgttagggaaacccggacggtacccgtagggtaaacgggaccggttacggtaaccggggaaccggttaaaccggaaaccccgggtccggttaccttaaacgttttacccgtacggttaggtacccggtaagttaaacgttttcgggttttaaccctggttacttaacgttcccgtttaaacgttagttttaacggttagtttacggggtcccttagttaacgttcgggtaaccgttcgggttaaccgggttttcccgggtaacccgggggg

SEQ ID NO: 339789 - DNA, 727 bp, Homo sapiens
  misc_feature: GZ8MTXP01DSFF8.17.10.A10.1.454.CMB.2.raw
  modified_base (273)..(273): a, c, t, g, unknown or other
  misc_feature (273)..(273): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagcgtggggcatcgagtgacttgtctcctgacgaggcagtagattatatcttacaataaatgtgtatgagtggngcgacgcggacccgagaggtcgtggagggtggggtgggggtggtacgacggtcggttcgtttacgggtaacgggtaaggactaacgtaggtagtacggaaccccgaaaccggaaaggtagtaaggggaacgggaacgaagtcggtaacgaaaccgtaacccgttaaccccgaacccggaaccccaaccccgaaacgaaacccaacgtacggtaactaacgtacgttacgaaccgtaacgtacggacgacgaccgagaacgtcgacggtacggacgaccgtaccggtacctacgttagtttacgtaggtacgtaacggttaagttacgttttgttttaacgtcgttaacgttacgtttaacgttaaaccgtttagttacgttagttacgttaacgttacgttaacggttacggttacggttaccgggttaaccggttccggggttaacccggggg

SEQ ID NO: 339790 - DNA, 708 bp, Homo sapiens
  misc_feature: GZ8MTXP01CT8UD.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagagccgtggggcatcagtgacttgtcctccgtgacaaggcctagtggtatattatcttacaactaaatagtgtatgagttggtcgcgacgaccggacccccggagaagggtcgttagggacgggtgggggtggggtcgggtacgtaggtcgggttcgtttagggaacggtacggacacgtagtagtcgaccgacgaagtagtaggacgacgagcgtacgaaccgtaacgtacccgaccggtaccccaaccccgaacgaaccgtaacgtactaactacgatacgacgtaacgtcgaacgtacgacgaggaacgacgtacggtaccgaaccggtaaccgaccgggttacccttacgttaaccgttcgttacggtacgtaccgttaagtttacgttttacggtttctacgttacgttaacgttacgttaaacgttacgtttaggttacgttaccggttcttaacgttaacgttaagggtccgttacgggttccggttccgggtaacccggggg

SEQ ID NO: 339791 - DNA, 634 bp, Homo sapiens
  misc_feature: GZ8MTXP01B8FQ5.17.10.A10.1.454.CMB.2.raw
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
tcagcgtagactagcacgaccggtgctcgattttagcgtcgatctcaggggacccaaaaaccacacccctccttgggagaatcccctagatcacagctcctcaccatggactggacctggagcattccttttcctggtggcagcaggcacaggtgcccacgcccaggttcaggttggtgcagacgtggggctggaggtgcagaagccgtggggcatcgagtgatgtctcctgcaagcagtgatatatcttaanaataatagtagtatagagtggcgacgacgaccggacccgagaggtgtaggnggtgggtgggtggtcgaggtcggtacgttagggaacggtagacagtagtagtacgaccgaacggaagagtaggaaggaacgaagtaacgtacgaacgtaaccgtaacccgaacccgaacccaaccccaacgaactacgtaacgtactaacgacacgaacgaacgacgacgacgacgagagtacgacggacgacgaccgaccggtccgtacgttacgtacgtagtacgtagtagtagtttgttcgtagttactacgttacgttaattaagttacgttagttacgtctagttaacggtacggtacgttacgggttaacgttcgggtaacggg

SEQ ID NO: 339792 - DNA, 708 bp, Homo sapiens
  misc_feature: GZ8MTXP01B33HW.17.10.A10.1.454.CMB.2.raw
  modified_base (258)..(258): a, c, t, g, unknown or other
  misc_feature (258)..(258): n is a, c, g, or t
  modified_base (367)..(367): a, c, t, g, unknown or other
  misc_feature (367)..(367): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatntggtatgaattgggtgcgacacggcccccggagaagggcttggaggtggggtgggggtggtcagcggtctttggacgggtaaggcacgagtagtgaccgaccggaaagngtaggaacggggacaaggaacgtcgaacggtacttaacccgaccgggaacccaccccccgaacgaaaccacgaacggttactacgaatcggaacctaacgtacgaacgacgaccgtaggaacgacggaccgtagggaaaccggaccgtaccggggtacccgttacgttaacgtttaaccgtgggtcggtaaccggtaaggttaaagtttcgggtttttaacctcgggtttacctaacgtttaccggttaaacttaaacgttttcggttaagttacggggtccttacggtttaagttacggggtaacgttcgggttaacccgtttcgggttaacccgggggg

SEQ ID NO: 339793 - DNA, 669 bp, Homo sapiens
  misc_feature: GZ8MTXP01D0O54.17.10.A10.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (599)..(599): a, c, t, g, unknown or other
  misc_feature (599)..(599): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcaggtgatatatcttacaanaaatngtatgatggtncgacacggccccgagagggtcttggaggtggggtgggggtcggtcgaggtcggtcgtttacgggaacgggttaaggactacgaggtaatcggacccgaaccggaaaggtagtaggggaaacgggaacgaacgggcgttaaccgaaaccggtaaacgttaaaccccggaaccggaaccccaaaccccccgaaacgtaaaccaaacgtacgttaccgtaacacgtacgaaccgaacgtacgaacgacgccgtaggaacgacgccggtaggaaccggaccgacgggtcccctagttaacgttcgtaggttcgacgtagtaagtttgtttccngttactattacgttaataagttgacgttaggtctacgtggtacggcttacggtcgtttcgggaaccgggg

SEQ ID NO: 339794 - DNA, 732 bp, Homo sapiens
  misc_feature: GZ8MTXP01A7B9Z.17.10.A10.1.454.CMB.2.raw
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
tcagcgtagactagcacgaccggtgctcgatttagcgtcgatctcaggggacccaaaaaccacacccctccttgggagaatcccctagatcacagctcctcaccatggactgggcctggagcattccttttcctggtggcagcaggcacaggtcgcccacgcccaggttcagttggtgcagacgtggggctggaggtgcagaagccgtggggcatcagtgactgtctctgcaagcagtgatatatctacanaaatgtgtatgagttggngcgacgaccgggtaccccggaagaagggtcgttaggaggggttgggggtagggggtcgggtacgagggtcgggtcgtttacgggaacgggttaaggctacgtaggtagtcggaaccgaccgggaaggacgtagggaacgggacaagtgtacgaacgtaacgttacccgaaccgggacccaaaccccgacgaaccacgacgtactacagtcggaactacgtacgacgacgccgtaggaacgtacgacggggtaacggaaaccccggaacccgtaccggggttaacccgttacctttaaacgtttaccggtagggttaccggtaaacgggtaagttttaaacggttttcggttttaacgtacgttaccgttaattacccggttaaattaaggttttaggctttacgggtccctttagtaagggttacgggacgttacgggtaacgtttcgggggaaacccggggg

SEQ ID NO: 339795 - DNA, 703 bp, Homo sapiens
  misc_feature: GZ8MTXP01AEFBO.17.10.A10.1.454.CMB.2.raw
  modified_base (473)..(473): a, c, t, g, unknown or other
  misc_feature (473)..(473): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaggccagtgatatatcttacaactaaatgtggtatgtaagttgggtgcgacgacgggacccccggagaagggtcgttggagggtgggggtggggtgggtcagggtcggtcgtttagggaacgggttaaggcaacgtagtagtggaccccgaaccggaaggagtacgggaagggcaaggaacgtcgaacgtatacccggaccggacctacccccaagacacgagtactacgatacggactaacgnggaaccgacgtccgtaggacgaggttaccgacggaacccggtaacgtaacccggggtccttaaccgtgttaaccgtgggttggtaccggttaagttaaagttttccgttttaacgcggttaacccttagttacccggttaaatttaaacgtttgttaaaccgttcgggtaactttaaccgtaagggttacggtaccgttagggtaacccggttttcggggaacccggggg

SEQ ID NO: 339796 - DNA, 737 bp, Homo sapiens
  misc_feature: GZ8MTXP01CR7AV.17.10.A10.1.454.CMB.2.raw
  modified_base (253)..(253): a, c, t, g, unknown or other
  misc_feature (253)..(253): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcaggaagccgtggggcatcagtgactgtctctgcaaggcagtgatatatcttacanaaatagtaggtatagaagttgggtagcgacgacggccccggaacgaagggtcttggagggtgggggtagggggtgggtcgaggtcgggtcgtttagggaacgggtaacggcgaacgtaggttagtacggacccaaccggaaaggtaggtaggggaaacggggaccgaagggaacggttaccaaaccggtaaacttaaaccccggaccccgggaaccccaaaccccccgtaaacgaaacccaacgtaaacggttacctaacaacgttacggaacaaccgtacggaaccggacgtaccgtagaacggacgaccggtaacggaacccgttaaccgacccgggtaccgttacttacgttaccgtaggtaccgtaggtacgttaaacgtttgtttaaccgttaggttactacgttacggttaaacttagttttagacgttagtcttagtaagtcgggtacgttacggtaacgttccgggtaaccggggg

SEQ ID NO: 339797 - DNA, 646 bp, Homo sapiens
  misc_feature: GZ8MTXP01BGLW9.17.10.A10.1.454.CMB.2.raw
  modified_base (289)..(289): a, c, t, g, unknown or other
  misc_feature (289)..(289): n is a, c, g, or t
  modified_base (565)..(565): a, c, t, g, unknown or other
  misc_feature (565)..(565): n is a, c, g, or t
  modified_base (600)..(600): a, c, t, g, unknown or other
  misc_feature (600)..(600): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaagccagtgatatatcttacacaaatatggtatgaatgggtgcgacacgggcccccgganaagggcttggaggtggggtgggggtgggtcgaggcggtcgttttacgacgggtaaggcacgtagtacgtaggacccaccggaaagagtaggaaaggggccgaaggtaaggtaccaaccgggtaagtttaacccccgaaccggggacccaaacccccccgacggtaaacccaacaacggtacctaacattacgaccaacttcggaacgacgccagaagtcgacggtacgacgaccgacggccgtcctagttactggtacggtccgtagtaacgtttntttaaccgtgttacagttccgtaacttaagttcgnttagggtctacgtaagtcggtattcggtaacttcggtaaccggggg

SEQ ID NO: 339798 - DNA, 567 bp, Homo sapiens
  misc_feature: GZ8MTXP01EOD0Q.17.10.A10.1.454.CMB.2.raw
  modified_base (380)..(380): a, c, t, g, unknown or other
  misc_feature (380)..(380): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccggagaagggcgttgaggtggggtgggggtgggtcgaggcgggtcgtttggacggtaaggcacgagtatgaccaccggaagagtggaagggcagngtcaacgacttaccgacggaccacccccgaacgaacacagtctacatgaccaacgtgacgagcctagagagtacgcgaacgaccgacggccgtctaagttactgtgtcgagtagttgtttctgttcagttacgtattaattgattacggtctacgtaagtcggacttgggtaacgttcgtccggggg

SEQ ID NO: 339799 - DNA, 715 bp, Homo sapiens
  misc_feature: GZ8MTXP01CN7JP.17.10.A10.1.454.CMB.2.raw
  modified_base (264)..(264): a, c, t, g, unknown or other
  misc_feature (264)..(264): n is a, c, g, or t
  modified_base (430)..(430): a, c, t, g, unknown or other
  misc_feature (430)..(430): n is a, c, g, or t
  modified_base (521)..(521): a, c, t, g, unknown or other
  misc_feature (521)..(521): n is a, c, g, or t
  modified_base (531)..(531): a, c, t, g, unknown or other
  misc_feature (531)..(531): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgacagaagccgtggggcatcgagtgactgtctcctgacaaggccagtgatatatcttacaactaaaatntggtaatgaagttgggtgcgacacgggcccccggaagtaacgggctttagggagggttgggggtgggggtgggttacgagggtcgggtcgttttgggaacgggtaagggcaacgtaggtaactgaaccccgaaccggaaagtacgtagggaaacggggactaaggnggtaccaaacgggtacttaaaccccgaccgggaaccccaaccccccgaagtaaaccacgaacgttcaacgatacggacaaacgtgacgacnccgaggacgngtacggacgaaccgacgaccggtcccgtattaacgttaccgtggtacgacggggtaacttacgtttggttttccgtagttccggtaactttacccgggtaaactttaagttttccggaagttacgggttaacccttagtaaggtccgggtaagttccggggtaacgtttcgggaacccgggggg

SEQ ID NO: 339800 - DNA, 647 bp, Homo sapiens
  misc_feature: GZ8MTXP01DVDJK.17.10.A10.1.454.CMB.2.raw
  modified_base (259)..(259): a, c, t, g, unknown or other
  misc_feature (259)..(259): n is a, c, g, or t
  modified_base (582)..(582): a, c, t, g, unknown or other
  misc_feature (582)..(582): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaagccgtggggcatcagtgactgtctctgcaaggcagtggatatatcttacaacaaatntgtatagagttggtgcgacgacggccccgagaaggtcttggaggtggggtggggtggtcgaggtcggtacgtttcggaacggtaggcacgtagtatcggaccgacggaagagtaggaagggacagaacgtacaacgtacttaacccgaccggtacccaccccgaagaacacgtatacacgatcgaacaacgtacgaacggtagaccgaggaacgaggacgtacggaacgaacggtacccggtcgtaacttagttacgtcggtaggtacgtaagttacgtttgtttcgtcgttacttacggttaccttaaagttaatttacggngttaacgggtccttagttaaggttacgggtacgttacgggtaaccgtttcggggtaacccggggg

SEQ ID NO: 339801 - DNA, 626 bp, Homo sapiens
  misc_feature: GZ8MTXP01BMW2J.17.10.A10.1.454.CMB.2.raw
  modified_base (257)..(257): a, c, t, g, unknown or other
  misc_feature (257)..(257): n is a, c, g, or t
  modified_base (396)..(396): a, c, t, g, unknown or other
  misc_feature (396)..(396): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggcagtgatatatcttacaactaaatntggtatgaagttgggtgcgaacgccggaccccgagaggtgtaggagggtggggtaggggtggagacggtcgggtttagttacgggaacggtacgacgtacgtagtagacgacccgaacggagtagaggacggaagtagngtaccaacgtacctaccgacccgacccaaccccgaacgaacacgtacgtcctaagaccagaacgacgacggacggcacgtagggagcgacggacgaaccggaccgtcccggtaccgttacttaagttcgtcggtacgacggttaaatttggttttcttaatcggttaactattacggtattaatttgagttcgtctaaatggtacgtcgacgttcgttcgggaaccgggg

SEQ ID NO: 339802 - DNA, 607 bp, Homo sapiens
  misc_feature: GZ8MTXP01EDTMA.17.10.A10.1.454.CMB.2.raw
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
  modified_base (453)..(453): a, c, t, g, unknown or other
  misc_feature (453)..(453): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaagccgtggggcatcagtgactgtctcctgcaaggcagtgatatatcttacaataaatagtaggtatagaagttgggtgcgacgacgggacccccggagaagggtcttaggaggttggggtagggggtggtcgaggtcggtcgtttagggacggtaggcacgagttancgaccacgaagagtaggaaggcaagngtcaacggtactaccgacggaaccaccccaagaacacagtacacatagacactgacgancgagagacgacgtagacgacgacggtccgtatattacgtgtcgtagtaaggttattggttttaactgttatacgtttaccgttaactaattttcggattacgggtccttagttaagtccggtagttacgggtaaccgtttcgggtaaccggggg

SEQ ID NO: 339803 - DNA, 687 bp, Homo sapiens
  misc_feature: GZ8MTXP01BYCLJ.17.10.A10.1.454.CMB.2.raw
  modified_base (403)..(403): a, c, t, g, unknown or other
  misc_feature (403)..(403): n is a, c, g, or t
  modified_base (437)..(437): a, c, t, g, unknown or other
  misc_feature (437)..(437): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggccagtgatatatcttacaacaaatgtaggtatagaagtgggtgcgacgacgggcccccggaagaagggtcttgggagggtgggggtgggggtgggtacgaggtcgggtcgtttaggacggggttaaggcaacgagtagtcgacccgaccggaaagagtaggaagggcagngtacaacgactacccgacggacccaaccccgaanaaccacacgtaccaacagtacgaccgtaacgtacggaccgaacggcccgtaggaacgtacgacggtacggaacccggaaccgtacccgggtcctacgttaacgttacgtacggttacggaccggttaagttacttttcggttttcgtcggttacttaacgttaccggtaaacttaagttttacgagttaccgtcgttaccgttaagttacgggtacgtttacgggtaaccgttttcgggtaaccgggggg

SEQ ID NO: 339804 - DNA, 552 bp, Homo sapiens
  misc_feature: GZ8MTXP01AYEZ1.17.10.A10.1.454.CMB.2.raw
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
  modified_base (491)..(491): a, c, t, g, unknown or other
  misc_feature (491)..(491): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacaggcccccggagaagggtcttggaggtggggtgggggtgggtcgaggcggtctttggacggtaaggcacgagtatgaccacgaagagtgaagggcagngtcaacgattaccgacggaccaccccagaactacagtctacatcgacaactgaacgagcctgacgagcgtacgacgacgacggcccgtntattactgtcgcgataattgtttcgtnttcattcgtaatattttgattacggtctcgtaagtggacttggtaacgtttcgaacggggg

SEQ ID NO: 339805 - DNA, 613 bp, Homo sapiens
  misc_feature: GZ8MTXP01C24Z2.17.10.A10.1.454.CMB.2.raw
  modified_base (384)..(384): a, c, t, g, unknown or other
  misc_feature (384)..(384): n is a, c, g, or t
  modified_base (470)..(470): a, c, t, g, unknown or other
  misc_feature (470)..(470): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaatatggtatgaattgggtgcgacacggcccccggagaagggcttggaggtggggtgggggtggggtcaggcggtcgtttggacggtaggcacgagtagtcgaccgaccggaagagtaggaaggggcaaggngtacgaacgtaacgttaccgaaccgggacccaaccccccgaacgaaccaacacggtactaacatacgactaacgtagacgacgccnggaagacggcggtacggaaccgaccgaccggccgttactacgttacgtgtcgtacgtagtaacttggtttcctgttctacttcgtaactatttagattacggtcttactaagtcgtacgttggtaacgttcggtaaccggggg

SEQ ID NO: 339806 - DNA, 691 bp, Homo sapiens
  misc_feature: GZ8MTXP01AH5U1.17.10.A10.1.454.CMB.2.raw
  modified_base (209)..(209): a, c, t, g, unknown or other
  misc_feature (209)..(209): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcggccggcccccgganaggacggtcaccatctctgctctacgaacccccatgtagattcaatatgntctgtacngcacnccggatcacgacccctaactcctacatatatagaaatactaaacgtacgtccgacctacggtacggggttccccacgtaccgtattccgtcgtacgggtccctaaccgtaacgttccgtacgggtacctaccggttacctcggaccccgtacccgttgggaccctacgtaccgacccggccgtaccgtaccgacggtacgggtacggggacgacgggtacgttacgttaacgtttcgacggccgacaaacgtcgtacgggacctttccgacgtcccgttaggtccgtttcgggttcggggttacgttcccgggagttacgggttaaccgggaaacccgaacggttccgttacccgggtaaccccggtacgttaacgggtaccgacccggttacccgaacgggttcccctttcccccggg

SEQ ID NO: 339807 - DNA, 840 bp, Homo sapiens
  misc_feature: GZ8MTXP01BGNEF.17.10.A10.1.454.CMB.2.raw
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtnactgtctcctgcaaggccagtgatatatcttacaacaaatatggtatagaagttgggtgcgacgacgggcccccgganaagggtctagagggtggggtgggggtcggtcgaggtcggtcgtttagggaccggtaaggccacgtaggtagtcgaccccaaccggaaaggtagtagggaaacggggaccaaggtaacgtacccaaaccgggtaaacctttaccccggaaaccccgggtaacccccgaaacccccccgtaaaacccgggaaacccaacgtaaccggtaccctaaactacgttacgggaaacccctaaacgttacggggaaacccggttaccggtaaccccgtagggaaagtacccggggttaactaaccggggaaaacccgggaccccggtaaacccgggggttaccccgtttaactttaaccgtttaaccggttaacgggtttcggtaaaccggttaagtttaaaccgttttggttttaacccgtaaggtttacttaacccggttttaggttaaaccttaaagtttttcggttaagttacggggtttaaccccgttactttaagggtaccggggtactttaccgggggtaaccgtttttcgggtaaccccgggggg

SEQ ID NO: 339808 - DNA, 654 bp, Homo sapiens
  misc_feature: GZ8MTXP01CDZBK.17.10.A10.1.454.CMB.2.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (325)..(325): a, c, t, g, unknown or other
  misc_feature (325)..(325): n is a, c, g, or t
tcagcgtagactagcacgaccggtgctcgatttagcgtcgatctcagggacccaaaaaccacacccctccttgggagaatccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgacaaggcagtgatatatcttanaanaaatntggtatagaagttggngcgacgacggccccggagaaggtcttaggagggtggggtgggggtcgggtnagggtcggtcgtttagggacggtaggcgaacgagtgtacgaccccgaaccgggaaagtagaggggaaacggacgaagtaacggtaccaaacggtaaccttaaccccgaaccgggaaccccaacccccgaaagtaccactacggtactacgatacgaacgtacgagacgcgacgtaggacgacgacgtacggaacacccgaccgggtaccttaccgtattacggttaggcgtaccgtaagttccgtttagtttcgtaggtttacaacgtttacggtaaattagttagttattcgtaactgtaagtcggacgttagtcgttggaaccgggg

SEQ ID NO: 339809 - DNA, 682 bp, Homo sapiens
  misc_feature: GZ8MTXP01C623B.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgacaggcagtgatatatcttacaacaaatatggtatgaagttgggtgcgaacgacgggcccccggagaagggtcgttggagggttgggggtgggggtcgggtacgaggcgggtcgttttagggaacgggttaagggctaacgtaggtatcggacccaaccggaagagtacgggacggggacaagcggtacaaccggtaacttacccgaaccggacccacccccgaagaaccacacggtactacgactacgacgtaacgtacggacgacggccctagggaagaccggtacggtacggaaccggaacccgtaccggggtacccgttaccttacgttacgttaggtcggtacggtaagtaagtttcgttttcgtgttactacgttacgttaactaagtttacgttagttacggtcttacgtaagttcggacgttcggttaacggttcggtaaccggggg

SEQ ID NO: 339810 - DNA, 660 bp, Homo sapiens
  misc_feature: GZ8MTXP01AV6MW.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtgggcatcagtgactgtctctgcaggccagtgatatatcttacaactaaatagtaggtataggtaagttggggtgcgaacgaccgggcccccggaagaagggtcgttagggaggtgggggtgggggtgggtcgagggtcggtcgtttaggacgggttaagggctacgtagtatcggaccccgacggaagtagtaggaagggacaaggcgtacgaacggaacttaacccgaccggaaccccaccccgaaacggaaccacgacgtacctacagtacgaccaaacgtcgaaccgtgaccagacgacgcggtgaccggtaacaccgggtacctacttagtaccgtggacgtacgtagttaacgtttcgtttaaccgttgactacgttcgttaaatagttttagacgttcggtaacttgtaagttacggcgttacgggttaaccgttcgggttaacccggggg

SEQ ID NO: 339811 - DNA, 707 bp, Homo sapiens
  misc_feature: GZ8MTXP01B8KAW.17.10.A10.1.454.CMB.2.raw
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (390)..(390): a, c, t, g, unknown or other
  misc_feature (390)..(390): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcagtcaggtgactgtctcctgcaaggcagtgatatatcttanaanaaatntgtatgaagtgggncgacacgggccccgagaggtcgtggagggtggggtagggggtggtcgaggtcggtgtttacgggaacggttaaggcacgagtagtcggaccgaacgaagagtaggaggtaacgagnggtacaacgacttaacccgaccggacccaacccccaagaaccacgtaagtactacatacgaacgaacgtcgaacgacgacgtaggaacgacggacggtaacggaaccggaaccggtacccgggtactttaccgttaacgtttacggtacggtacggtaacgggttaaagttaacgttttgggttttaaccttacgtttaccgtaacgtttaaccggtttaaaagtttcgtttaagggttaacttacgggttaaccgtttacgttaaggttacggggtaacgtttcggggtaacccggtttcggggtaacccgggggg

SEQ ID NO: 339812 - DNA, 623 bp, Homo sapiens
  misc_feature: GZ8MTXP01EGED3.17.10.A10.1.454.CMB.2.raw
  modified_base (275)..(275): a, c, t, g, unknown or other
  misc_feature (275)..(275): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacaacaaaatatggtaatagaattgggtncgacacggccccgagaaggtcgttgaggtgggtggggtggtcaggcggtnttaggacggtaaggcacgagtatgccaccggagataggaacggacagngtacacgacttaccgacggaccacccagacacagtctagactgacaacgtcgacgtacgcctagaacgacgtcgtacggacgtaaccgaccgggtcccttacgtacgtttaccgtaggttacgacggttaacttaaggtttgttttaaccgtgttaaccgttacttacggttaaccttaaagtttggttacttacggggtaacctacgttaagttcggacgttacgggttccgttcgggtaacccggggg

SEQ ID NO: 339813 - DNA, 681 bp, Homo sapiens
  misc_feature: GZ8MTXP01DYS3T.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctcctgcaaggccagtgatatatcttacacaaatatggtaatagaattgggtgcgacgacggcccccggagaagggcttggaggtggggtgggggtgggtcaggcggtacgtttggaacgggttaaggcaacgagtatgaccccaaccggaagactgggaaaggggacaaggtaaggtacaaaccggtaacgtttaaccccgaaaccggggaacccaacccccccgaaacggaaaccaaccgtaacggtacctaaccataggaccaaacgttacgaaccggacgacccgtagaacgacggacgttacggaccggaacgaacccggggtccttaactacgtttaactggcgtacggtaacgtaaattcggtttttctggttacctagttcgttaaactatttgggattaacgggtcttacgtcgtgggaacgttcgggttaacgttcgggtaaccggggg

SEQ ID NO: 339814 - DNA, 744 bp, Homo sapiens
  misc_feature: GZ8MTXP01BKYD3.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgcaaggccagtgatatatcttacaacaaaatatggtataggaagttgggtgcgaacgacgggacccccggagaagggtcttaggagggttgggggtgggggtgggtcaggcggtcgtttaggacgggtaaggcacgagtatcgacccaaccggaaagtagtagggaaacggtccgaaggtaacggtacgaacggtaaacttaaccccggaacccgggaaccccaaaccccccgaaacgaaacctaacgtaacggtacctaaacgtaacttacggaaaccctaacgttacggaaccgtaacgacccgtaggaacgtacggcgttaacggaaccgtaccgaccgggtcctacgttaacgttgtacgggtgtaccggtaagttaacttttcgggttttaactagggttacccttaaagtttacccgggtaaacttttaagtttacggaacgtttacgggaacctttagttaacggttacggggtacgttacggggtaaccgttttccgggaacccgggggg

SEQ ID NO: 339815 - DNA, 696 bp, Homo sapiens
  misc_feature: GZ8MTXP01DEIO9.17.10.A10.1.454.CMB.2.raw
  modified_base (364)..(364): a, c, t, g, unknown or other
  misc_feature (364)..(364): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcaggaagccgtggggcatcagtgactgtctctgcagcagtgatatatcttacaacaaatagtgtatgagttgggtgcgacgaccgggcccccgagaaggtcgttggagggtggggtgggggtgggtacgaggtcgggtcgtttgggaacggtaaggcgacgtaaggtntacgacccgaaccggaaaggtagtaaggaaggggaacaaggtaagaccgaaaccggtaacgttaaaccccgaccgggaaccccaacccccgaacgaaaccaacacgtactacgatacgacaacgtgaaccgagaccgagacgacgacggtacgaaccggtaccaacccgggtccttaacgttactttacgtacggtccgtaggttaattacgtttcgttttcgtacgttacttagttaccgttaaagtttaagtttaggttacgttaacgggttcttacgtaacggttagggtacgttacggggtttaaccgtttcggggtaaccccggggg

SEQ ID NO: 339816 - DNA, 650 bp, Homo sapiens
  misc_feature: GZ8MTXP01CKJI1.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggcagtggatatatcttacacaaatatggtatgaagttgggtgcgacgacgggccccccggagtaaggggctttaggagggtggggtgggggtgggtcgaggtccggtgtttggaacgggtaaggcgacgagtatacggcccaaccggtaagagtaggaacggggcaaggaagtacgaacgaactttacccggaaccggacccaaaccccccgaacgaaccaacctacgtaccgtacagtcgactaacgtcgacgacgtccgtaggagacgacggtgaaccgaccggaccggtccgttacctacgtttacgtacggtcggtacgtagttaacgtttcgttttaacgtgttactattcggtaaccttagtttgacgttacggtctgttaagtggtacttggtaaccgttcggtaaccgggg

SEQ ID NO: 339817 - DNA, 694 bp, Homo sapiens
  misc_feature: GZ8MTXP01DLY77.17.10.A10.1.454.CMB.2.raw
  modified_base (277)..(277): a, c, t, g, unknown or other
  misc_feature (277)..(277): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaactaaatagtggtatgaagttgggngacgacgaccggcccccggagaagggtcttggagggtggggtgggggtgggtcgaggtcggtcgtttagggaacggttaaggcaacgtagtagtcggaccccgaaccggaaaggtagtaggaaacggggacgaaggtaacggtaccaacggtaaaccgttaaccccgaacccgggaacccctaaccccccgaacgaaaccacgacgtactacgatacgaccaaacgtcgaacgacgaccgtaggacgtacgacggtacggaaccgaccgaccgggtccttacttacgttacgtggtacgtacgtaagttaagtttcggtttaactacgttctaacgttaccgttaaagttaagtttagacgttacgttcttacgtaaggttcggtacgttacggttccggtttcgggtaaccggggg

SEQ ID NO: 339818 - DNA, 694 bp, Homo sapiens
  misc_feature: GZ8MTXP01ES81Q.17.10.A10.1.454.CMB.2.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatcttanaanaaatntgtatgaagttggncgacacggccccgagagggtctggaggtgggggtaggggtcggtacgaggtcggtcgtttacgggaaacgggtacggactaacgagtacgtacggacccaacgggtaagagtacggggaagggtaccaaggtaagtacctaaacggtacttaccccggaaccgggaacccacccccgaaagaaccacgtaacgttacaacagtacgaaccgtaacgttaggaccgtagacccgaggaagtcgacggtacggaaccgaccggaccgggtaccttaccttagttacgtcgcggtaagtaacgttagtttcgtttccgtaaggttactaacggtttacctaagtttaaagttcgttaaggttaccgggttctacgtttaacggtacggtacgttaacgggttcgttaaccggggtaacccggggg

SEQ ID NO: 339819 - DNA, 664 bp, Homo sapiens
  misc_feature: GZ8MTXP01CEJZW.17.10.A10.1.454.CMB.2.raw
  modified_base (390)..(390): a, c, t, g, unknown or other
  misc_feature (390)..(390): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagaagccgtggggcatcagtgactgtctctgcaaggccagtgatatatctacaacaaatataggtatagaagttgggtcgcgacgacggacccccggagaagggcttggagggtggggtgggggtggtcgaggcggtgtttagggacggtaggcacgtagtatagacccacggaagagtagggaggaacgagngtacaacgtactaaccgaccgggaccccaacccccgaaacgaaccaacgtacgtacctaacgtacgttacgaaccgtaacgtacggaaccggtacgcccgttaggacggtaccggacggtaacggacccggaaccgtacccggtaccggttacttacgttaccgtggtcgtacgtaggtatttcggtttaactgttactacgttacgttaacttagttaggttattacggtcttagtaagtcggtagttacggtaacgtttcggtaaccggggg

SEQ ID NO: 339820 - DNA, 613 bp, Homo sapiens
  misc_feature: GZ8MTXP01A077L.17.10.A10.1.454.CMB.2.raw
  modified_base (330)..(330): a, c, t, g, unknown or other
  misc_feature (330)..(330): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtgggcatcagtgactgtctctgcaaggcagtgatatatcttacacaaatatggtatagaagttcgggtgcgacgacggacccccggagaagggtcttggaggtggggtgggggtggtcaggcggtntttggacggtaaggcacgagtatcgaccgaacggaagagtaggaaggacagaagtccaggtacttaccgacggaccaccccgagaacacagtcacancgacacgngaacgagccnggaagacgtcggcggaacgacgaccggtccgtactacttaccgtgcggtaccgtagtaacgtttgttaagtcttaccgagttacccggtaaattaagttttagaacggttacgtaacccgttactaagtacgggtacgttccggtaacgtttcggggtaacccggggg

SEQ ID NO: 339821 - DNA, 710 bp, Homo sapiens
  misc_feature: GZ8MTXP01CNX48.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagccgtggggcatcagtgactgtctcctgcaaggcaggtgatatatcttacaacaaatataggtatgaagttgggtgcgacgacggcccccggagaagggtcttggaggtggggtgggggtgggtcgaggcggtcgtttgggaacggtaaggcacgtagtatggacccgaaccggaagagtagggaaggggacaaggaacgtacgaacgtacgttaacccgaccgggaacccaaccccccgaacggaaccacgacggtacctacgacgttagaccgtaacgcggaacgtacgacccgtaggagacggtcggacggaaccggaccgaccgggtccttacgtacgttacgttaggtacgtaccggtaagttaagtttcggttttaaccgtagttacgtaaacgttaccggttaaaaccgttaagttttaggaacgttacgggttaacccttacgttaaggttacgggtaccggtttacggggttaaccggtttcggggttaacccgggggggg

SEQ ID NO: 339822 - DNA, 627 bp, Homo sapiens
  misc_feature: GZ8MTXP01EVKGM.17.10.A10.1.454.CMB.2.raw
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (329)..(329): a, c, t, g, unknown or other
  misc_feature (329)..(329): n is a, c, g, or t
  modified_base (514)..(514): a, c, t, g, unknown or other
  misc_feature (514)..(514): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacaacaaaatntggtatgaattgggtncgacgacggcccccggagaagggcttggaggtgggtgggggtggtcaggcggtntttggacggtaggcacagtatgacccacggaagagtaggaagggacaaggcgtacgaacgtacgttacccgacgggacccacccccgaagaaccacgtagtactacagtcgaactaacgtcggacgtacgccctaggaacgacgcgtacggaaccgaccgaccggtccgtacgttagtttaccgnggtcgtacgtaagttaacgtttgtttcctggttactagttacgtaactaagtttacgagttacgggtcttacgtaagtcgggtaacttcgggtaacgtttcgggaaccggggg

SEQ ID NO: 339823 - DNA, 710 bp, Homo sapiens
  misc_feature: GZ8MTXP01AIM8P.17.10.A10.1.454.CMB.2.raw
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggcagtggatatatcttanaacaaatntggtatgaagttgggtgcgacgacgggcccccggagaagggtcttggagggtgggggtgggggtcggtcagggcgggtgttttagggaacggtaaggcacgtagtatcggacccaacgggagtagtagggaacggggacaagggtcgtaccgaaacggtacttaaccccgaccgggaacccaaacccccgaacgaaaccacgtacggtacctaacagttcgaaccgtaaacgtggaaccggacgcccgtaaggacggaacggcggtacggaaccggtacgacccggggtccttacgttacgttacgtacggccggtaagtagtttaagttcgggttttaactgggttactacgttacggttaaactttaagtttcggttaacgttcggttaaccgttcgttaagggttacgggtaccggttagggttaaccgtttcgggggtaacccgggggg

SEQ ID NO: 339824 - DNA, 588 bp, Homo sapiens
  misc_feature: GZ8MTXP01ER9GW.17.10.A10.1.454.CMB.2.raw
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtgcccacgcccaggttcagttggtgcagacgtggggctggaggtgcagaagccgtggggcatcagtgactgtctctgacaaggccagtgatatatcttacaataaatntggtatgattggngacgnacgacgccgacgagtgtgtggtgggtgggtggtgngtcggtcgttaggtaagggtacgacgacgtaaagtagtcgaccgaaacggaaagtagtagggaacgggacgagtacgacgaacgtaacgtaaccgaaccgaaccccgaaccccgaaaccgaaacaacgtacgtacctaacagacgacgtacgtacggaacgacgacgagagacgacgacgaacgaaccgaccgtcgtaacttacttagtgttcgtacgtaagttagtttcgtttcgttctagtaacgttacgttacttagttaagttaagtaag

SEQ ID NO: 339825 - DNA, 792 bp, Homo sapiens
  misc_feature: GZ8MTXP01EU5YY.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggcagtggatatatcttacaacaaaatataggtatagaagttgggtgcgacgacgggcccccggagaagggctttggaggttgggggtgggggtgggtcgaggtcgggtcgtttgggaacggttaagggctaacgtagtagtcggacccaaccggtaaaggacgtagggaaacggggcgaaggaacggtaccaacgtacgtttaaaccccgaaccgggaacccaaccccccgaaacggaaaccaaccgtaacggtaccgttaacagttacgaaccgaaacgttacggaaccggacgaccccgttaggaacggacggaccggttacggaaacccggaaccgtaacccgggtcccggtttacttaacgtttacggttacggttacggaaccggttaaacgttaaaggttttcgggtttttcctttagggttaaccttaaacgttttacccgggttaaactttaaaacggttttcgggttaaaggttacgggttaacctttacggttaaggttacggggtacgttacggggttaaccgttttaaccggggtaacccgggggg

SEQ ID NO: 339826 - DNA, 682 bp, Homo sapiens
  misc_feature: GZ8MTXP01CU0FV.17.10.A10.1.454.CMB.2.raw
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgacttgtctcctgacgaaggcagtgatatatcttacaanaaatntagtatagaagttggagcgacgaccgggacccccgagaaggtcgttaggagggtggggtggggtgggtcaggtcggtcgtttaggacggtagcagagtatcgacccacggtaagagtagggaacggaacagaacgtactaaacgtaacgtaaccccgacggaaccccaccccgaaacgtaacacacgtacanaatcgaacacgtagacgganccgagaaacgcgtcggaacggaaccggaacgtacccgggtacgttaacccttaagttccgtagggtaccgtaaggtaatttaacggtttcttttaacgacggttcttaaacggttaccgttaaagttaagtttttcgaggtttaacgtccggttaacttaaggttaccgggtagttaccgggttaaccggtttcggggtaaccggggg

SEQ ID NO: 339827 - DNA, 597 bp, Homo sapiens
  misc_feature: GZ8MTXP01EU2VD.17.10.A10.1.454.CMB.2.raw
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (511)..(511): a, c, t, g, unknown or other
  misc_feature (511)..(511): n is a, c, g, or t
  modified_base (549)..(549): a, c, t, g, unknown or other
  misc_feature (549)..(549): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcgagaagccgtggggcatcagtgactgtctcctgacaaggcagtgatatatctacaanaaatntggtatagaagttggtgacgacgacggcccccggaagaagggtcttaggagggtggggtgggggtggtacgaggtcggtacgtttagggaacgggtaagcacgtagtacgtcgaaccacggaaagagtaggaaggacaagcgtacacgtactaccgacgaccaccccagaacacganactagatgacatgacgagctgacgngtcgacgacgacgacgccgtntactgtcgagtctaggtatttgttcgtnttactagttaccgtaattaagtttagttagttacggtnttacgtaagtacgggtacgttcgggtaaccgtttcggggaaccggggg

SEQ ID NO: 339828 - DNA, 741 bp, Homo sapiens
  misc_feature: GZ8MTXP01BVLYX.17.10.A10.1.454.CMB.2.raw
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtgggcatcagtgactgtctcctgcaaggcagtgatatatcttacaactaaatgtggtatgagttgggtcncgaacncgggcccccgagaacgggtnttaggaggggtggggtgggggtggtacgaggcggttatttaggacgggtaggacacgagtntacgcccgaacggagtagtaggaaggggccaaggaacgttccgaaacgtaacgttaccccggaccggacccaaaccccccgagaaaccctacgaacggttacctaacgtacttacggaacccgtaaacgtcggaaccggtacgtaccgttaaggacgtacggtcccggtaacgggaaccggtacccggtacgggtacccgttacgttacgtttaaccgtgggttcggtaaccggtagtttaaacgttttcggttttaacgaaccgtttacgtaaacgtttcggtaaaccgtttaaggttttcgacggtttacgggttcccttagttaacggtacgggtaacggttacgggtttccccggttgggggttaaccccgggggg

SEQ ID NO: 339829 - DNA, 642 bp, Homo sapiens
  misc_feature: GZ8MTXP01AT7IO.17.10.A10.1.454.CMB.2.raw
  modified_base (248)..(248): a, c, t, g, unknown or other
  misc_feature (248)..(248): n is a, c, g, or t
  modified_base (474)..(474): a, c, t, g, unknown or other
  misc_feature (474)..(474): n is a, c, g, or t
  modified_base (556)..(556): a, c, t, g, unknown or other
  misc_feature (556)..(556): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctgaggtgcagaagccgtgggcatcagtgactgtctcctgcaaggcagtgatatatctanaactaaatgtaggtatagaagttgggtcgacgacgaccggcccccggagaagggtcttggagggtggggtggggtggtcaggtcggtgttaggaacggtagcacgtagtacgcgaccgaacggagtacgaggaacggcgaagtgtaccgaacgtactacccgaccgggacccaaacccccgaataacccagacgttaccaacgatcgaccaaggtgaaccggtacnccgagaagacgacggacggaacccgaccgaccgggttacctcgttaagttcgttggacgtaccgtaaagttctttggtttcngttacacgtttaccgtaaattaaggttgacttcggtccttagtcggtaggtacccgttgggttaacccgttggggtaacccggggg

SEQ ID NO: 339830 - DNA, 749 bp, Homo sapiens
  misc_feature: GZ8MTXP01CLAD2.17.10.A10.1.454.CMB.2.raw
tcagcgtagactagcacgaccggtgctcgatttagcgtcgatctcaggggacccaaaaacccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctctgcaaggcagtggatatatcttacaataaatagtggtatgaattgggtgcgacgacggcccccggagaagggtcttggagggttggggtagggggtggggtacagggtcggtcgttttagggaacggtaggcacgagtagtcggaccctaaccggagagtagggaacgggtacgaaggcggtaccgaaccggtaacgttaaccccggaaccggaaccccaaccccccgaaacggaaaccaccgaacgtacctaacgacttacgaccgtaaacgtagaaccggagaccgtaggaacgacggaccggtacggaaccgacccggtaccgggtacccgttacgttaacgtttaccgttagggtacggtaccggtaaaggttaacgttttcggttttaaccgttacggttacgttaacgttaccggttaaagtttaacgttttacggaacgtttacggggtaaccctttaacggttaaggttacgggtacggttaccgggttaaccggtttcgggggttaaccccgggggg

SEQ ID NO: 339831 - DNA, 668 bp, Homo sapiens
  misc_feature: GZ8MTXP01B7NVG.17.10.A10.1.454.CMB.2.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctgggtggcagcaggcacaggtcgcccacgcccaggttcagttggtgcagacgtggggctggaggtgacgaggaacgcgtggggcatcgaggtgacttcgtctctgacaggcaggtagattatactctaacaactaaatgtaggtatagaagttggngacgacgacggccccgagaggctaggaggtggggtgggtcggacgnggtcggttgtttagggaacggtaggctacgtaagtacgtcgaaccgtaacggaagagtacgggaggtacaagcgtacgaaaccggtaacgtaccccgaacggaacccccaaaccccgacgaaacactacggtactaacgagtacgaacgtaaacgacggaaccgacggtccaggaacgacggtacgacggaaccggacgtaccgggtactcgttaacgttcgtagccggtagtaatttcgttattttcggcttacttagttacgttaaacgttgttagttcggttagtccttagtaacgtcggacggttacggtcgttcggggtaaccggggg

SEQ ID NO: 339832 - DNA, 643 bp, Homo sapiens
  misc_feature: GZ8MTXP01DZX6Q.17.10.A10.1.454.CMB.2.raw
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaggcagtgatatatcttnaacaaatatgtatagagttggngcgacgacggccccgagaggctggaggtggggtggggtggtcaggcggtgtttggacggtagcacgtagtatcgacccgacggaagagtaggaaggacaaggaagtaccgaacgtaacgttacccgaaccgggacccaacccccgaacgaaaccgacgtaacgtactaaccagttacgaaccgaactacggaccgacgtaccgtagaacgacgcgtacggaacgaccgaccggtccttacgttacgttacgtggtcgtacgtaagtttacgttgttttcctaggttcctaaacgtttacgttaaacgttatttacggattacggtcttagtaaggtcggtacggttacgggttaaccgttcgggtaacccggggg

SEQ ID NO: 339833 - DNA, 628 bp, Homo sapiens
  misc_feature: GZ8MTXP01CD5MQ.17.10.A10.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (375)..(375): a, c, t, g, unknown or other
  misc_feature (375)..(375): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgacaaggcagtgatatatcttacanaaatntgtatagagtggngcgacgacggccccgganagggctggagggtgggtgggggtggtcaggtcggtgtttaggacggtaaggcacgtagtatgacccacggagagtaggaaggcagngtacaacgtactaccgaccggacccaccccgaacgacacagtactacagtacgacaacgtgacgacgtcctaggagacgcgtacggaaccgaccgaccggtccttacgtacgttacgtaggtcgtacgtaagttaacgtttcgtttaacgtcgttacctagttaccggttaaattaagtttagttaacgttagggtccctttagtaaggtcgggttaacggttcgggttaaccgtttccgggtaaccgggggg

SEQ ID NO: 339834 - DNA, 639 bp, Homo sapiens
  misc_feature: GZ8MTXP01AGOE2.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaagccagtgatatatcttacaacaaatatggtatgaagttgggtgcgacgacggcccccggagaagggcgttggaggtggggtgggggtgggtcgaggtcgggtcgtttggaacgggtaaggcacgagtatgacccaccggaagagtagggaagggacaagggaacgttacgaaccgtacgttacccgaaccgggaacccaaccccccgaacgaaaccacgacgtacctaacgactacgacaacgtagaccgacgccgtgaacgacgcggtacgacgaccgaccggtccgtacgttattaccgtgtgtccgaagtacttgtttctcgttactacgttacgttactaagtttggagttacgggtcttacgtgttaacggtccgttaggttaaccgttcgggtaacccggggg

SEQ ID NO: 339835 - DNA, 737 bp, Homo sapiens
  misc_feature: GZ8MTXP01DQZGB.17.10.A10.1.454.CMB.2.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaactaaatntaggtataggaattggggtgcgaacgaccgggaccccccggagaagggctttggagggtggggtgggggtgggtcgaggcgggtcgttttagggaacgggttaacggcgaactaggtagtcggaccgaaccggaaagtacgtagggaaacggggtcaagggtaacggtacaaacgtaaacttaaccccgaaccgggaacccaacccccaacgaacacgtacgtactacagttgaacctaacgtcggaaccgacgacccgtggaacgacgtacggttaacggaaccggaacccgtacccgggtacccgttactaacgtttaaccgtggttacggaccgtagttaaaccgtttggttttaaccgtttgttacgttaacgttaaccggtaatttaaacgttttggaaaccgtttgggaacctttacgttaacggttgggtaccgtttacggggttaaccgttttccgggtaaccgggggg

SEQ ID NO: 339836 - DNA, 631 bp, Homo sapiens
  misc_feature: GZ8MTXP01D5F0P.17.10.A10.1.454.CMB.2.raw
  modified_base (387)..(387): a, c, t, g, unknown or other
  misc_feature (387)..(387): n is a, c, g, or t
  modified_base (451)..(451): a, c, t, g, unknown or other
  misc_feature (451)..(451): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctctgcaaggcagtgatatatcttacacaaatatggtatgaagttgggtgcgacgacggcccccggagaaggcgtgaggtggggtgggggtgggtcgaggcggtcgtttcggaacggtaaggcaacgagtagtggaccaaccggaaagagtaggaaagggcaaggngtacgaaacgtaacttaacccgaaccggaacccaacccccgaacgaaaccacacgtactactanacgacaacgtagacgacgtccgagaagacgcgacggaacgaccaccgggtccgtcttaacgttagtgtcgacgtagtaatttcggttttctcggttactaacgttacggttaaacttaagtttagacgttaggtccttagttaagtggtacgttgggtaaccgttcgggtaacccggggg

SEQ ID NO: 339837 - DNA, 688 bp, Homo sapiens
  misc_feature: GZ8MTXP01DCXM8.17.10.A10.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcaggaagccgtggggcatcagtgactgtctcctgcgaaggcagtgatatatctanataaatntgtatgagtggngcgacacggccccgagaggtctggaggtgggtggggtggtcgaggtcggtcgtttgggaacggtaggcacgagtatcgacccacggaagtagtaggaaggggacaagaacgtcgaacgtaactaacccgaccggaaccccaaccccgaaacgaaaccacgtaacgtacctaactacgtacgaacgtaaaccgtcggaaaccggacgacccgttaggaaacgtaccggtaccgggtacgggaaacccggaaccgtaaacccgggtcccgttaacttaacgtttacgtacgggtacggtacgggtaacttaagttttcgttttcgtaacgttctaacgttacggttaacttaagtttacgagttacgggtctacgttaagtccgggtagttacgggtaaccgttccggggtaaccggggg

SEQ ID NO: 339838 - DNA, 554 bp, Homo sapiens
  misc_feature: GZ8MTXP01C50P4.17.10.A10.1.454.CMB.2.raw
  modified_base (294)..(294): a, c, t, g, unknown or other
  misc_feature (294)..(294): n is a, c, g, or t
  modified_base (379)..(379): a, c, t, g, unknown or other
  misc_feature (379)..(379): n is a, c, g, or t
  modified_base (439)..(439): a, c, t, g, unknown or other
  misc_feature (439)..(439): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatataggtaatgaaattgggtgcgacaggccccccgganaagggctttggaggtgggtgggggtgggtcagcggctttggacggtaaggcagagtatcggccaccgaaagatggaaggggcagngtcaacgaattaaccacggacacccccagaacacagtcaacatgacactagacgagaccngagagacgacgacgacacggccgtcctattatagtgtcgagaatagtttnttgttcattcgtaataatttagttnttaggtctataagtgacgttaggtaacgttccgttggggg

SEQ ID NO: 339839 - DNA, 641 bp, Homo sapiens
  misc_feature: GZ8MTXP01B1A0B.17.10.A10.1.454.CMB.2.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctctgcaaggcagtgatatatctacanaaatntggtatgaatgggtnacgacgacggacccgagaggcgtgagggtgggtgggggtggtcgaggtcggtcgtttgggaacggtacggacagtagtagtacgaccgaaccggagagtagggaaggacagtaacgtacaacggtacttaacccgaccggacccaacccccgtaagaacacgacgtacacatcggaactacgtgacgtacgcctaggagtacgcggtacgaccggaaccgccggtaccgtactagttacgtggtacggtacgtagtaagtttcggtttaactcgttacgttagttcgtaacgttaagtttacggttagttacgggtaaccttcgtaagttcgggtacgttacgggttaaccgtttcgggggtaacccggggg

SEQ ID NO: 339840 - DNA, 733 bp, Homo sapiens
  misc_feature: GZ8MTXP01DIZO9.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatctacaacaaatntggtatgaagttgggtgcgacgacggcccccggagaagggcttggacgggttgggggtgggggtgggtacaggtcgggtcgtttagggaacggtaaggcaacgtagtatcggacccgaaccggaagagtaggaaaggggtacaagggcgtaccaaacggtaactaacccgaaccggacccaacccccgaacgaaccacgtagtactacacgtacgaacaacgtacgaacgacgtaccgagaacggacgacggtacggaacccggtaaccgtaacccggggtacccgttacttaaccgtttaccgttaggtacggtaaccggttaaaggttaaacgttttcggtttttaaccgtacgggtttacctaaaccggtttacggtttaaaccttaaggttttaccggttaggttacggttaacttaaccgttaaggttcggtaaccggttcgggtaaccgttttccgggggtaaccggggg

SEQ ID NO: 339841 - DNA, 678 bp, Homo sapiens
  misc_feature: GZ8MTXP01AKDBR.17.10.A10.1.454.CMB.2.raw
  modified_base (256)..(256): a, c, t, g, unknown or other
  misc_feature (256)..(256): n is a, c, g, or t
  modified_base (593)..(593): a, c, t, g, unknown or other
  misc_feature (593)..(593): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtgggcatcagtgactgtctctgcaaggccagtgatatatcttacaactaaatntaggtatgaagttgggtgcgacgacggcccccggagaagggtcttggagggtgggggtgggggtcggtcgaggtcgggtacgtttagggaacgggttaagggacaacgtaggtaagtcggacccgaaccggaaggtagtagggaaacgggcgaagggtcgtacaacgggtaacttaccccggaaccggacccaaaccccccgaaacgaacccaacgtacgttacctacagtcgaacctaacgacgacgacgcgtaggacgacgacggacggaaccggaccgtaccgggtaccgttactagttacgtcgtaggtaccgtaagttactttcggttttcncgttactagttacgttaacttaaagtttgttaacgttcggtccttagtaagtcggtacggttagttccgttcgggtaaccggggg

SEQ ID NO: 339842 - DNA, 629 bp, Homo sapiens
  misc_feature: GZ8MTXP01AIS1K.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatagaattgggtgcgacaggcccccgagaaggcgtgaggtggggtgggggtgggtcgagcgggtcgtttggaacggtaaggcaacgagtagtgaccaaccgaagaagtaggaaagggacaagaacgtacaaccgattaaccccgaacggaaccaaccccccgaaccgaaaccaacaacgtactaacatacgacaactagacgacgcctagagagcgtagaacgtacgacggtaccgtattacttactggttcgacgtaagtaatttcgttttcgtgttcctaagttacgttaaacttaagtttacgaagttagggtccttactaacgttagggtaacgttcgggttaaccgttcggtaaccgggggg

SEQ ID NO: 339843 - DNA, 751 bp, Homo sapiens
  misc_feature: GZ8MTXP01DXDQU.17.10.A10.1.454.CMB.2.raw
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctctgacaaggcagtggatatatcttanaactaaaatntaggtataggaagttgggtnacgacgaccgggcccccgagaagggtctggagggtggggtgggggtgggtcaggtcggtcgtttagggaacgggttaacgggctaacgtaggtacgtcggaaccccgaacggtaaagagtacggaaacggggacgaaggtaacggtcaaacgtaacgttaaccccgaaccgggaaccccaacccccgaaagtaacaaaccgtacggtaacctaacgacgtacggaaccaaacgtacggaacgacggttaccgagaacgacggtacgtaacggaaccggaaccggtaaccgggtaccgtttacttaacggtttacgtacggtaccgtaaagttaaacggttattttccgggttttaatacggttactaacggtttaccgttaaacgttaagttttcggaagttacgggtaaccttagttaacgggttacgtacgggttacgggttaaccgtttaaccgggggtaaccggggg

SEQ ID NO: 339844 - DNA, 604 bp, Homo sapiens
  misc_feature: GZ8MTXP01BZAIL.17.10.A10.1.454.CMB.2.raw
  modified_base (251)..(251): a, c, t, g, unknown or other
  misc_feature (251)..(251): n is a, c, g, or t
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
  modified_base (483)..(483): a, c, t, g, unknown or other
  misc_feature (483)..(483): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtgatatatcttacanaaatatggtatgaattgggtgcgacgacggcccccggacgaagggtcttggagggtgggggtgggggtggggtcaggcggtcgtttgggacggtaggcagagtatgccaccggagagtagagggacagngtcacgactaccacggaccaccccacgacacacgtcacatnacaacgtgacgagtcctagagacgcgtagaccgtacgacggtccgtcgtacttacgttaggngtacgtagttaacgtttcgttttctcgttactaagttacggttaaactaagttttagacgttcgggtaacttacgtaagttcgggtaacgttcgggttaaccgtttcgggtaaccgggggg

SEQ ID NO: 339845 - DNA, 606 bp, Homo sapiens
  misc_feature: GZ8MTXP01AITDG.17.10.A10.1.454.CMB.2.raw
  modified_base (247)..(247): a, c, t, g, unknown or other
  misc_feature (247)..(247): n is a, c, g, or t
  modified_base (429)..(429): a, c, t, g, unknown or other
  misc_feature (429)..(429): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtgggcatcagtgactgtctccgtgcaaggccagtgatatatctanaataaatatgtatgaattgggtgcgacgacggccccggagaaggtctggaggtggggtgggggtggtcgaggtcggtcgtttagggacggtaaggcacgagtagtcgaccaaccggaagagtggaaggcgaagtcgtacacgtaattacccgacgaaccaccccaacgacacagtacacgangacacgtgacgcgacctgacgagcgtacgacgaccgaccgggctacgtactacgtgcgtacgtaggtaactttgtttcaggttacctaagttacccggttaaattaacgtttgttacgttacgggtccttagttaacggtacggtacttacggggttccgttcggggtaaccggggg

SEQ ID NO: 339846 - DNA, 612 bp, Homo sapiens
  misc_feature: GZ8MTXP01CQ8BV.17.10.A10.1.454.CMB.2.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (544)..(544): a, c, t, g, unknown or other
  misc_feature (544)..(544): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggcagtgatatatctanacaaatntggtatgaattgggagcgacgacggaccccgagaaggctggaggtgggtggggtggtcaggcggtctttagggacggtagcaagagtatcgaccacggaagagtaggaaagggcaaggtcgtacgaaacgtaacgttaacccgaaccgggaacccaacccccgaaacgaacaacgtaggtacctacgattacggactaacgtgaacgaagccgtagacgtacggctacggaaccgacgaccgggtacttactaagttacgagttcgacgtaagtatttggttttccnggttcttagttcgtaataagttttgattacggtctagtaagtgtacgttggtaaccgttgggccgggg

SEQ ID NO: 339847 - DNA, 638 bp, Homo sapiens
  misc_feature: GZ8MTXP01ARWN1.17.10.A10.1.454.CMB.2.raw
  modified_base (224)..(224): a, c, t, g, unknown or other
  misc_feature (224)..(224): n is a, c, g, or t
  modified_base (348)..(348): a, c, t, g, unknown or other
  misc_feature (348)..(348): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagagccgtgggcatcagtgactgtctcngcgaggcagtgtatatatcttacaataaatagtgtatgaagttgggtgcgacgaccggccccggagagggtcttggagggtgggggtgggggtggtcgaggtcggtgttaggaacgggtagcanagtgtcgaccgaacggagagtaggaaggacagaacgtcacgtactacccgacggaccaccccaagacacgtacgtactacattcgaactaacgtcggaacgacggtccaggacgacgtcgggacgaaccggaccgcccgggtacttacttagttaccgttgacggtaccgtaagtttacgtttcgtttcgtggttacttacgttacgtaacttaaggtttcgacgttagggtcctttggtaagttcccgggggtattaccggggtaacggtttcggggtaacccgggggg

SEQ ID NO: 339848 - DNA, 655 bp, Homo sapiens
  misc_feature: GZ8MTXP01B22BZ.17.10.A10.1.454.CMB.2.raw
  modified_base (480)..(480): a, c, t, g, unknown or other
  misc_feature (480)..(480): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagagcgtgggcatcagtgactgtctcctgcaaggccagtgatatatcttacacaaatatggtatagaagttgggtgcgacacgggcccccggagaagggcttcggaggtggggtgggggttgggtcgaggtcggtcgtttggacgggttaaggcacgagtatcgccgaaccgagagtacggagggaacgagtaacgtacaaccgtacttaaccccgaacgggaccccaacccccgaacggtaaccacgtacgtacgtactacgtgaaccaacgtgacgcgaccgngacgacgcgtacggaccgaccgaacccgggtcccttaccgtacgtttacgtggtacggtacgtacgtaacgtttcgttttctgggttcttacgttcgttaacttaagtttacgttgttacggtctacgttaacgttacgggtacttacgggttaaccgttcggttaacccggggg

SEQ ID NO: 339849 - DNA, 618 bp, Homo sapiens
  misc_feature: GZ8MTXP01ACPLA.17.10.A10.1.454.CMB.2.raw
  modified_base (248)..(248): a, c, t, g, unknown or other
  misc_feature (248)..(248): n is a, c, g, or t
  modified_base (535)..(535): a, c, t, g, unknown or other
  misc_feature (535)..(535): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatatggtatgaattggggtgcgacgacgggacccccggagaaacgggcttggaggtgggggtgggggtgggtcgaggcgggtctttaggacggtaaggcgacgagtagtgccgaaccggaagagtggaagggacaggaagtacgacgtattacccacgggaccacccccaagaacctacacgtactacagtcgacaacgtacgacgagcctaggagagcgtaggacgaccgaccggtaccgtctaacgttacgtgtacgcggtaagtaagtttcggttttcngttaccgtattcgtaacttaagtttcgagttacggtctacgttaacgttggtaacgttggtaaccgtttcgggtaaccggggg

SEQ ID NO: 339850 - DNA, 692 bp, Homo sapiens
  misc_feature: GZ8MTXP01AIVLU.17.10.A10.1.454.CMB.2.raw
  modified_base (591)..(591): a, c, t, g, unknown or other
  misc_feature (591)..(591): n is a, c, g, or t
  modified_base (613)..(613): a, c, t, g, unknown or other
  misc_feature (613)..(613): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtcctcctgacgaacggcaggtggattatatcttacaacaaaattgtggtatagaagttgggtgccggacgtaccggcccccggagaagggcgttggagggtggggtgggggtgggtcgagggtcggtagttttcgggaacgggttaacggcaacgaggttagacggaccccgaaaccggaagtacgtaggggaacggaacgaagaacggtaccaaccggtaacgttaaccccgaaccgggaaacccctaaccccccgaaacgaaacctaaccgaacggtaacctaacgacttacggaacctaaacgtcgggaacgacgccgtaagacgagtcggaggaacccgaccgaccgggtccgtctagtacgtcggngtacgtagtactttgtttcgtnttacttacgttaaccgtattaagtttggattcgggtcttagtaacgttcggacgttggtccgtttcgggaacccggggg

SEQ ID NO: 339851 - DNA, 730 bp, Homo sapiens
  misc_feature: GZ8MTXP01EW2QM.17.10.A10.1.454.CMB.2.raw
  modified_base (252)..(252): a, c, t, g, unknown or other
  misc_feature (252)..(252): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagagccgtggggcatcagtgactgtcctctgcaaggcagtgatatatcttacaanaaatagtggtatgagttggtgcgacgacggccccggagaggtcgtggagggtggggtgggggtggcgaggtcggtcgtttagggacgggtaaggcacgtagtagtcggacccgaaccggaagtaagagggaaggacgaaggtaacgtacgaaaccggtaaccttaaccccgaaccgggaaccccaacccccgaaacgaacctaacgtaacggtactaacaagttacgaaccgaaacttcgggaaccgagccccgtagggaaacgtacggtaccgaacgggaaccccggtaaccggtaccccgggtccggttaacctttaacgtttaccgtgggtaccggtacgtaaggttaacgttttcggttttcttaggttaccctaggtttaccgttaaatttaaacgtttaggttaccttagggtccttaacgttaaggttcgggtaacgttggggttaacccgtttcgggggtaacccggggg

SEQ ID NO: 339852 - DNA, 741 bp, Homo sapiens
  misc_feature: GZ8MTXP01DT5VU.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatcttacaactaaatagtggtataggaagttgggtgcggacgacgggacccccggacgaaagggtcgttggaggggttggggtagggggtgggtcgtaggcgggttcgtttagggaacgggttaagggctaacgagtagtcgaccgaaccggaagacgtaggaacggggtaacaaggaacggtacgaacgtaacgttaaccccgaaccggaaccccaaaccccccgaaacgaaacccgaacgtacggttacaaccgtaagttacgaacaaacgtacggaaccgacgtacccgtaggaaacgacggaccggtacggaaacccggtaaccgtaaacccggggtccttacgttaacgtttaacccgttggtacggtaccggttaaagttaacgttttcgggttttaacttacggttactacgtttaacggttaaacgttagtttacgttagttacggtaacttcgtaagtcggtaccgttggttcgttcgggtaaccggggg

SEQ ID NO: 339853 - DNA, 738 bp, Homo sapiens
  misc_feature: GZ8MTXP01DW2LJ.17.10.A10.1.454.CMB.2.raw
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgaggaagccgtggggcatcagtgactgtctcctgacaaggcagtgatatatcttanaacaaatgtagtatgaagttgggngcgaacgtaccgggacccccggaacgaagggtcttaggagggtgggggtgggggtgggtcagggcggtcgtttgggaacggtacgacacgtagtagtcgaccgaaccggaagtacgtaggaagggaaccgaggtaacgtacaaccggtaacgttaaccccgaacccggaccccaaacccccgaacgaaaccacgtacgtactacgacttacgaaccgtacgtaggaaccgtacgacccgtaggaaacgaccggtacggtaaccggaaaccggtaacccggtaacccgggtacccgttaacgtttaacccgtttacggttaagggtacccggtaacggtaaacggttaagttttcggttttaaccgtagttacccgtaagtttacggtaaaccttagtttaacgttagttacggtcttcgtaaggttacggtccgttaggtaaccgttcggggtaaccgggg

SEQ ID NO: 339854 - DNA, 696 bp, Homo sapiens
  misc_feature: GZ8MTXP01BVOKB.17.10.A10.1.454.CMB.2.raw
  modified_base (278)..(278): a, c, t, g, unknown or other
  misc_feature (278)..(278): n is a, c, g, or t
  modified_base (579)..(579): a, c, t, g, unknown or other
  misc_feature (579)..(579): n is a, c, g, or t
  modified_base (585)..(585): a, c, t, g, unknown or other
  misc_feature (585)..(585): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtgggctgaggtgcagagccgtgggcatcgagtgactgtctcgtgacgaaggcagtggtatatatacttacaataaatgtaggtatagagttgggngacgacgaccggtccccggagagggtcttggaggggtggggtgggggtcggtacgaggtcgggttacgtttagggaacggttacggactacgtagttacgcggaacccgaaccggaaagtacgtaagggaacgggaacagggtaacgtacgaaaccgggtaaccttaaccccggacccggaaacccccaacccccggaaataacccaacgaacgttactaactacgcgaacctacgtacggacggacgccgtaggaagacgtcggaacggaccgaccgtaccgggctttactacgttaagngtacgngttaacgttattggtttaacctgttaactcggttagttaattgttagttcgttacgttaacgttcgtaaggttcgggtacgttcgggtaaccgttcgggggtaacccgggg

SEQ ID NO: 339855 - DNA, 786 bp, Homo sapiens
  misc_feature: GZ8MTXP01BGKP1.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggcagtgatatatcttacacaaatatggtatgaagttgggtgcgacgacggcccccggagaagggctttggaggtggggtgggggtggggtcaggcgggtcgtttaggaaggttaacggcaacgagtacgtgacccgaaccggaaagagtacgggaaggggacccaaagggtgtaccgaaaccgtaaacgtttaacccccgaacggggaaccccaaaccccccgaaaccggaaacctaacgtaaccggtacttacaagttacgaacctaacccgtaggaaccgtacggacccgttaggaacgggtaaccggacggttaacggggaaacccgaacccggtaaccggggttaccccgggttaacttaaccgtttacccggttaaggtcccgggtaagggttaaacccggttaacgttttaaggtttttaacccgttgggttaaccctaaagggttttacccgtaaagttaaaccgttttcgggttaagttacgggtaaccctttacgttaagggttacggtaacgttcggggtaaccgttttcggggtaacccgggggg

SEQ ID NO: 339856 - DNA, 650 bp, Homo sapiens
  misc_feature: GZ8MTXP01A1DHV.17.10.A10.1.454.CMB.2.raw
  modified_base (560)..(560): a, c, t, g, unknown or other
  misc_feature (560)..(560): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaactaaaatagtggtatagaattgggtgacgacgacggcccccggacgaagggtcttggaggtggggtgggggtgggtcgaggtcgggtacgtttgggaacgggtaaggacacgaggtatcggacccgaaccggaaagagtagggaacgggacaagggaacgtcgaaacgtaacgttaacccgaccggaccccaacccccgaaacgaaccacgagtacctacatacgacaacgtgacgacgcctagacgagaccgtagaccgtaacgccggccgttctagtcgtagtcgacgtagtacttcggtttcncgttactagttaccgttaaagttaacgtttggacgttacggtcttacgttaaggtcggtacgttacgggtcgttttccgggaaccggggg

SEQ ID NO: 339857 - DNA, 611 bp, Homo sapiens
  misc_feature: GZ8MTXP01AW83J.17.10.A10.1.454.CMB.2.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttacaanaaaatatggtatgaattgggtgcgacaggccccccggaanaagggtcttggagtgggtcgggggtggtcagcggctttggacggtaaggctaangttangaccaacgaagagaggaaggacaagaagtacgaacgtaacgtacccgaaccgacccaacccccaacgaaccactacgtacaacagtacgacaacgtacgaacgacgacgtacgagagacggtacgacgaccgaccggaccgttacgtacgttacgtagtcgtagaacgtaacgttgtttctgttactacgttacgttaacgtaagttagttagttacgtcgtagttaagtacggtacgttacgtaacgttcggtcgggg

SEQ ID NO: 339858 - DNA, 724 bp, Homo sapiens
  misc_feature: GZ8MTXP01DV4UM.17.10.A10.1.454.CMB.2.raw
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (659)..(659): a, c, t, g, unknown or other
  misc_feature (659)..(659): n is a, c, g, or t
tcagcgtagactagcacgaccggtgctcgatttagcgtcgatctcaggggacccaaaaaccacacccctccttgggagaatccctagatcacagctcctcaccatggactggacctggagcattccttttcctggtggcagcaggcacaggtcgcccacgcccaggttcagttggtgcagacgtggggctggaggtgcagaagccgtggggcatcagtgactgtctctgcaaggcagtggatatatcttacaactaaaatntggtatagaagttgggngcgacgacggccccggagaagggtcttgggaggtgggggtgggggtgggtacgaggtcggtcgtttgggaacggtaaggctaacgagtagtcggacccaacggaaagagtacgggaaggacgagaacgtcgaaacgtactaacccgaccgggaacccaacccccgaacgaaactacgaggttacaacacgtacgaaccaaacctggaaccggaacggtcctaagggaaacgtacggaccccggggttaaggaaaccccggtaaaccgccccgggggttaacccgttactttaaacggtttccgttacgggaggaccggttaaattaacgttttcgttttcgtcgttactacggttaccgtttaaaggttaatttaccgggnttaaccgggctttacggtaagttcgggtaacgttccggggttaactttcggggtaacccgggggg

SEQ ID NO: 339859 - DNA, 790 bp, Homo sapiens
  misc_feature: GZ8MTXP01B2MSI.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaaggccagtggatatatcttcaacaaaatatggtatgaagttgggtgcgacgacggacccccggagaagggcgttggaggtggggtggggtggtcaggcggtcgttttggaacggttaaggccacgtagtagtcgacccgtaaccggaaagtagtaggaaacggggtaccgaaggtaacggtaccgtaaacgggtaaaccgtttaaacccccgaacccggggtaacccaacccccccgaaaccgggaaacccaacgtaacgggttaacccttaacgaacgtttacggaccctaaaccgttcgggaaaccgggtacgtacccgtagggacgtaacggcgttaacggaccggaacccgtaccgggtccgttaccgtaacgttttacccgtagggtaggtacccggtaaggttaaagttttcgggtttttaaccttgggttacctaaacgtttcccggttaaaactttaaccggttttacggaagttttacgggtaacctttccgttaagggtttaccggggtaacgtttcgggggtaacccgtttttcggggtaacccgggggg

SEQ ID NO: 339860 - DNA, 571 bp, Homo sapiens
  misc_feature: GZ8MTXP01D9IJN.17.10.A10.1.454.CMB.2.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (489)..(489): a, c, t, g, unknown or other
  misc_feature (489)..(489): n is a, c, g, or t
  modified_base (534)..(534): a, c, t, g, unknown or other
  misc_feature (534)..(534): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgaggaagccgtggggcatcagtgactgtctctgacaggcagtgatatatctanaanaatagtgtatgagtgggngcgacgacggccccgagaggtntaggnggtgggtggggtggtcaggcggtgttacggacggtagcagagtgngacacgagagtaggaggacagngacagtactaccgacgacccaccccgtaacgaactacgacgttacacgtancgacaacgtcgacganccgtagacgacgtcgagaaccgacgaccggtcgtattacgtagtgagtcgtaagttntttggttctagttctagttccgtaagttattcgttagttacgttntcgtaagtcgcgttaggtaacgttcgggtaaccgggg

SEQ ID NO: 339861 - DNA, 661 bp, Homo sapiens
  misc_feature: GZ8MTXP01EEJPO.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaagcagtggatatatcttacaacaaatatggtatgaagttgggtgcgaacacggcccccggagaagggcttggaggtggggtgggggtgggtcgaggcggtcgtttagggaacggttaagggcaacgagtagtcgacccgaaccggaaagagtaggaaggggaaccaaggcggttaccgaacgtaaaccgttaacccgaaccgggacccaaacccccgaacgaaaccgacacggttacaacagttacgactaacgtcgacgacgccgagagacgcgtaggacgaccgaccgggtcctacgttacgttacgtagtcgtacgtagtaaccgtttggtttcgttcgttacgtacttacggtaacttaagttttagttagttacggtcttaacgtgttaacggtcgttacgggtaacgtttcgggttaaccggggg

SEQ ID NO: 339862 - DNA, 655 bp, Homo sapiens
  misc_feature: GZ8MTXP01BG8WT.17.10.A10.1.454.CMB.2.raw
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcgagaagccgtggggcatcagtgactgtctctgacaaggcagtgatatatctananaaatgtgtatgaagtggtncgacacggccccgagaggntggagggtgggtggggtggtcgaggtcggtgtttaggaacggtaaggcaacgtgtagtgacccgaacgaagagtaggaacggacaaggtcgacgaacgtacttaacccgaaccgaccccaccccgaaacgaaccactacggtacatacagacgaactacgacgagtccgagaacgacgacggtacgaaccggtaccgaccggtccgttacgtacgtttacgtggttacgtaccggtaaagtttaacgtttcggttttcgttacgttactaacgtttacgttaaaccgtttaagtttaggttagttacgggttaattccggttaagtacggtacggttacgggttccgttggggtaacccggggg

SEQ ID NO: 339863 - DNA, 627 bp, Homo sapiens
  misc_feature: GZ8MTXP01D0MUR.17.10.A10.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (415)..(415): a, c, t, g, unknown or other
  misc_feature (415)..(415): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgacaaggcagtgatatatcttanaacaaatntaggtatagtaagttgggtanacgaccgacgggacccccggaagaacgggtctaggacggggtggggtgggggtcgggtacagggcggtacgtttagggaacgggttagctaacgtagtacgtcgaccgaaccggaagagtaggaacggaacaaggngtacaacgtactacccacggacccaccccgaaacacacgactactacatacgaactagtacgacgtacgcgtagagacgtcgacgaacgacgaccgtcgtactagtacgtgcgtagtacgtatttcggttctgttactacgttacgtaatttagttgttacttcggtaacttgtaacgttcggacgttcggtaaccgttgggtaaccggggg

SEQ ID NO: 339864 - DNA, 638 bp, Homo sapiens
  misc_feature: GZ8MTXP01B62BB.17.10.A10.1.454.CMB.2.raw
  modified_base (357)..(357): a, c, t, g, unknown or other
  misc_feature (357)..(357): n is a, c, g, or t
  modified_base (462)..(462): a, c, t, g, unknown or other
  misc_feature (462)..(462): n is a, c, g, or t
  modified_base (595)..(595): a, c, t, g, unknown or other
  misc_feature (595)..(595): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacacggtgcccacgcccaggttcagttggtgcagacgtggggctggaggtgcaggaagccgtggggcatcagtgactgtctctgcaaggccagtgatatatcttacaataaatgtggtatggaattgggtgcgacgacggccccggagaaggcttggagggtggggtggggtggtcaggcggtcgtttaggaacgggtaagcacgtagtntcgacccgaacggagagtaggaagggacaaggaacgtcgaaacggtacttaaccccgacggaaccccaacccccgaaacgaacacgacgtcaagactagacacgngaacgacgcaggacgacgtcggtacgacggaccacgggtacctacgtaattccgtagttcgacggtaagttaattttcgttttaacgtacttcgtaacgtttacgttaaacttaagttttagacttacgggtntacgtaagtcggtacgttcgttaacggttcgggtaaccggggg

SEQ ID NO: 339865 - DNA, 624 bp, Homo sapiens
  misc_feature: GZ8MTXP01CRGDC.17.10.A10.1.454.CMB.2.raw
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (377)..(377): a, c, t, g, unknown or other
  misc_feature (377)..(377): n is a, c, g, or t
  modified_base (459)..(459): a, c, t, g, unknown or other
  misc_feature (459)..(459): n is a, c, g, or t
  modified_base (565)..(565): a, c, t, g, unknown or other
  misc_feature (565)..(565): n is a, c, g, or t
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtcgcccacgcccaggttcaggttggtgcagacgtggggctgaggtgcagagccgtgggcatcagtgactgtctctgacaaggccagtgatatatctanaanaaatntgtatgaagttggngacgacgacggccccgagaggcgttggagggttggggtgggggtggtacgaggtcggtcgtttagggaacggtaagggctacgagtgtacgacccgaacggagngtaggaaggtaacaggtaacgtacgaaaccgtaacgtaacccggaaccgaaccccaaaccccgaacgtaacactagttacanatacgaactaacgagaccggagtcgagagcggttacgacgacgaacgccggtccttataccgttagtcgagtcgtaatgttgtttcagttctacgttataaagttnttaggacgttagcccttaagtcgtcgggtacttcggggtaaccttgggggtaaccgggg

SEQ ID NO: 339866 - DNA, 809 bp, Homo sapiens
  misc_feature: GZ8MTXP01CDX6M.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtgcccacgcccaggttcaggttggtgcaggacgtggggcttggaggtgacgaaggaacggccgtggggcagtcgaggtcgacttcgtcctccgtgacgtaacggccgtaaggtggtattattactacttaacaaactaaaatgtaggtataggtaaggttgggcgacgaccgaccgggacccccggaaggtaagggtcgttagggaggggttgggggtacgggggtgggtaccgtacggtcgggttagtttacggggaacgggtaacggccgtaagtacggtagtacggaacccgaaccggaagacgggtaggggaacgggacgaaacggtcgtaccgaaaccgttaaccgtaaccccggacccgggaacccccaacccccgaaacgtaaccgaacgtacggtactacgagtcccggaactaacggtacgacggtacgacgtacgggaagcgtaccggtaacgggaccccggtaaaccgtacccggttcccgtaactttaacggttaccggttaggttaccgtaaccgggtttaaggttacccttttgggttttcctaacggttactaaacggtttacgttaaacgtttgttacggttacgttacggttctacggtaagtccgttaggttcggttaacggttcgggtaaccggggg

SEQ ID NO: 339867 - DNA, 771 bp, Homo sapiens
  misc_feature: GZ8MTXP01DJX9C.17.10.A10.1.454.CMB.2.raw
  modified_base (252)..(252): a, c, t, g, unknown or other
  misc_feature (252)..(252): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagaagccgtggggcatcagtgactgtctcctgcaaggccagtggatatatcttanaacaaatatggtatgaattgggtgacgacgacggcccccggagaagggcttggaggtggggtgggggtgggtcaggtcggtcgttttagggaacggtaaggtcaacgagtagtcgaccccgaccggaaagagtaggaacgggtaacgagaacggtcaaacgtaacgttaacccgaaccgggaacccaaccccccgaaaccggaaaccaaccgtaacggtaccttaacgaacgttacgacctaaacgttacggaaccggtacgaccccgttaggaacgacggacggtacgaaccggaccgtaacccgggtaccggttacctttaacgttaaccgttcggtacggtaacgggtaaaccgttaaagttttggtttttccgttaacgggttccttaaacgtttaccggtttaaaaccgttaaacggttttagttaaacggttacgggttcccctttaaggttaacgtttcgggtaaaccgggtttcgggttaaaccgttttccggggttaaccccgggggggg

SEQ ID NO: 339868 - DNA, 715 bp, Homo sapiens
  misc_feature: GZ8MTXP01AXBRX.17.10.A10.1.454.CMB.2.raw
  modified_base (280)..(280): a, c, t, g, unknown or other
  misc_feature (280)..(280): n is a, c, g, or t
  modified_base (513)..(513): a, c, t, g, unknown or other
  misc_feature (513)..(513): n is a, c, g, or t
  modified_base (604)..(604): a, c, t, g, unknown or other
  misc_feature (604)..(604): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaacgccgtggggcagtcagtgactgtctctgcgaggcagtgatatatcttacaacaaatgtaggtataggaagttgggtnaccgtaccgaccgggaccccccggaagaacggggtcgttgggagggttcggggggtgggggtcggggtcgacgggtcgggtcggtttaggggaccggggtaaggccaacgtaggtacgtcggaccgaaccggtaaggtagtaggaacgggtacgaagaacgtaccgaacgtaactacccgaccggacccaaccccgaacgaacactagtacacgactgaccacgtagaccgancgtacggagtacgcggtacggaacccgtacggaaccccggttctacgttacgttacgtcggtggtaaaccggttattacggtttcgtttcncggtttacacgttttaaacccgtagtaacgttttgggaacgttaccgggtcgtttacgaaggtttccggggtacgttacggggttaacccgttttcggggggaacccgggg

SEQ ID NO: 339869 - DNA, 708 bp, Homo sapiens
  misc_feature: GZ8MTXP01CSMB5.17.10.A10.1.454.CMB.2.raw
  modified_base (656)..(656): a, c, t, g, unknown or other
  misc_feature (656)..(656): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagcctggggcatcgagtgactgtctcctgacaggccagtggatatatcttacaacaaattatggtatagaagttgggtgcgacgaccggacccccggagtaagggcttggagggttgggggtgggggtcgggtcgagggtccggtacgttttagggaacgggtaagggcctaacgaggttactcggacccgtaaaccggaagacgtaagggaacggtaccgaaggtaacgtacgaaccggtaacttaaccccgaccgggaaccccaacccccgaacgaaaccacgtaacgtacctacagtacgactaaacgtcggaaccggacgccgtaggacgacggtaccgtacggaacccggtaccgtaaacccgggtccccggtttactacgtttaccggttagtcgtacgtaagttacgtttacgttttcgtgttactcgttacgtaacttagtttggttnttacgggtcccttagtaacgtggtcgttggtaaccgttttcgggtccggggg

SEQ ID NO: 339870 - DNA, 622 bp, Homo sapiens
  misc_feature: GZ8MTXP01EOCKY.17.10.A10.1.454.CMB.2.raw
  modified_base (261)..(261): a, c, t, g, unknown or other
  misc_feature (261)..(261): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcgaggaagcctggggcatcagtgactgtctccgtgcaaggccagtggatatatcttacacaaaatntggtatgaattgggtgcgacgacggcccccggagaagggtctggaggtggggtgggggtgggtcaggtcgggtcgtttggacggtaaggcacgagtatgaccaccggaagatggaaggacgagtaagtcaacgacttaccgacggaccaacccccagaactacgagtcaacatacggacaacgtgacccgagacccgtaggagacgttcggacggacgaaccgtaccggaccgttctacgttaacgtggtgacggtagtaacttggtttcctggttcacttcgtaaacgttaactttgggttaattacgggtccttacgttaagtaccgggtagttacggtccgttttcgtaaccgggggg

SEQ ID NO: 339871 - DNA, 828 bp, Homo sapiens
  misc_feature: GZ8MTXP01A70V5.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcgaagcagtgatatatacttacaataaatgtggtatagaagttgggtgcgaacgaccgggcccccgaagaacggggtcttggaggggttggggtgggggtaggtcggacggtcggttcggtttagggaacgggttaacggaccaagtaggtatacggacccaaccgggaagtaggagggaaggggaacgaagtaacggtaccgtaaacggtaacccgttaaacccggaaccccgggtaaccccaaaccccccggaaacggtaaaccctaaccgtaacggttacccgttaacagttacccggaacgtaaacccgttaggaacccgaaggtcccgtaagggaacggaacgttaccgggtaacgggtaacccgggaaacccgttacccgggggttaccctttaacccggttaatttaacccggttacggggttagtaacccgggttaagtttaaacggtttttccgtttaacgtttaaccgttcggttaaacttttaccgtaaacgttttaggttttgttaaacggttacgggtttaaccttggttaaacggtttcggggtacgtttacgggggttcccgttttcgggggtaacccgggggg

SEQ ID NO: 339872 - DNA, 653 bp, Homo sapiens
  misc_feature: GZ8MTXP01BN972.17.10.A10.1.454.CMB.2.raw
  modified_base (249)..(249): a, c, t, g, unknown or other
  misc_feature (249)..(249): n is a, c, g, or t
  modified_base (307)..(307): a, c, t, g, unknown or other
  misc_feature (307)..(307): n is a, c, g, or t
  modified_base (355)..(355): a, c, t, g, unknown or other
  misc_feature (355)..(355): n is a, c, g, or t
  modified_base (417)..(417): a, c, t, g, unknown or other
  misc_feature (417)..(417): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctctgacaaggcagtgatatatcttanaactaaatgtaggtatggaacgttgggcgacgacgacggccccgagacgggtctaggngggtggggtggggtcggtgaggtcggtgttagggacggtagcagagtntacgaccgaacgtagagtgaggacagcgacacgtactaccgaccgaccaccccgagtaacanacgttacaacgtatacgaccgacgtacgacgcgaccgtgaagtccgcggtacggaacgtaccgacccgggtcttacgtaacttcggagttaccgagttagtttaacgttcggttttctaacgttcgttaaacgtttacggtaaacgttaatttagggttccgttaaacgggttcccgttagtaacggttacggggtaaacgttccggggttaacgttccgggggtaaccccggggg

SEQ ID NO: 339873 - DNA, 732 bp, Homo sapiens
  misc_feature: GZ8MTXP01A6578.17.10.A10.1.454.CMB.2.raw
  modified_base (274)..(274): a, c, t, g, unknown or other
  misc_feature (274)..(274): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaggcagtgatatatcttacaactaaatgtaggtatgaagttgggtncgaacgacgggcccccggagaagggtcttgggaggtggggtgggggtggtcgaggtccggtagtttacggaagggtacggcaacgtaggtatcgacccgaacggaagtaggtaggaacggggcaagggtaacgtacgaaccgggtaactaccccgaaccgggaaccccacccccgtaaacggaaactacgaacggtacctaaacgacgtacgaaccgtaacgtacggaacccggagtaccgtaagggacgtacggtaccggaacggaacccgtaccggacccgggttaaccgttacgttaacgtttaccggagggttacgtaacggttagttaccgttttcggtttaacgtacgttaccgtaacgtttaaccggttaaagttaacggtttacgggttacgttaccggtccttagttaacggtacgggtaccgttacgggtccggttaacggggcgggg

SEQ ID NO: 339874 - DNA, 831 bp, Homo sapiens
  misc_feature: GZ8MTXP01AOFK1.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcaggactggggctggaggtgcagaagccgtggggcatcagtgactgtctcctgcgaaggccagtggattatatcttacaactaaaattataggtatggaagttgggtgacgacgaccggcccccggagaagggtcttggagggtggggtgggggtggtcgaggcggtcgtttagggaacgggttaaggcgtaacgtaggtagtacgacccgtaaaccggaaagtagtaacgggaaggggaccaagggtaacggtaccaaaccgggtaacgttaaaccccgacccggggaaccctaccccccgaaaggaacccaacgtaacggtacctaacacgttagaacccaagtacggacggaacaccgtggaaacgtcgggaaccgtacgggaaaccgaaccggtacccgggttacccgtaccgtttaaaacgttaccggttcgggggttaaacggtaccggtaaaacggttttaagtttttcggggtttttaaccccgtaggtttaaaccggttaaccgttttaaacccggggttaaacttttaaaaacgggttttcgggtttaaaagttaacccggggtttaacttaaccgggttaagtttaccggggttaacggttaccggggtttaacggggtttaacccgggggtaacccggggggg

SEQ ID NO: 339875 - DNA, 628 bp, Homo sapiens
  misc_feature: GZ8MTXP01EYR3C.17.10.A10.1.454.CMB.2.raw
  modified_base (187)..(187): a, c, t, g, unknown or other
  misc_feature (187)..(187): n is a, c, g, or t
  modified_base (379)..(379): a, c, t, g, unknown or other
  misc_feature (379)..(379): n is a, c, g, or t
  modified_base (458)..(458): a, c, t, g, unknown or other
  misc_feature (458)..(458): n is a, c, g, or t
  modified_base (502)..(502): a, c, t, g, unknown or other
  misc_feature (502)..(502): n is a, c, g, or t
  modified_base (554)..(554): a, c, t, g, unknown or other
  misc_feature (554)..(554): n is a, c, g, or t
tcagcgtagactagcacgaccggtgctcgatttagcgtcgatctcaggggagctctgcttcagctgtgagcgcagaaggcaggactcgggacaatcttcatcatgacctgcctcccctctcctcctcacccttctcattcactgcacagggtcctggcccagtctgtgttgacacacgcccgccctnagtcgtctcgccggcccccggagaggacgtcacctatctctcgctctaccgaaaccccctatgtgattcaattgtgctctgtacagccgaaccgtcccggatccaaccgtaccccctaaactccactataactatagaaactaagtaaacgtaacgcccgtacctcggtaacgggttccccctacgtacgtnttccctaccgtaaccgacccctaagtccgtcgggcctaccgtcgtcccgaccgtaccccgtggaccacgtcccacgccncgtaccgacggtacgtcggggacgacggacgtagttacttcggngcgacctagagtcggacttccgagtcctgtacgtttcggtgggttcgtacgnggtacgttcgggacctaagccgttacggccgtccggtaagtccacggacccgttacggtcccttcggtcccccg

SEQ ID NO: 339876 - DNA, 671 bp, Homo sapiens
  misc_feature: GZ8MTXP01AS9YZ.17.10.A10.1.454.CMB.2.raw
  modified_base (237)..(237): a, c, t, g, unknown or other
  misc_feature (237)..(237): n is a, c, g, or t
tcagcgtagactagcacgaccggtgctcgatttagcgtcgatctcatgggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagcgtgggcatcagtgactgtctctgcagcagtgatatntctacaactaaatatagtatagtagttgggtgacgacgacggccccggagagggctaggaggtgggggtggggtggtcgaggtcggtcgtttaggaacggttaggacacgagtactacgacgacgaagagtaggaacgggacaagacgtacgaacgtacgtaccgaccgtaaccaaccccaacgaacctacgacgtaactacgaagtacgaacgtaacgtacgacgtacgacgtaagacgacggggtacgacggtaaccgaccgtaccggtaccgttcttaacgttacggttacgtacggtacgttagttaaacgttttcgttttcgttacggtttcaacgtttaaccgtaacgtttaacgttcggttaacgtttaacgggtacttaacgttaacggttcggttacggttaacgggttaaccggtttccggggg

SEQ ID NO: 339877 - DNA, 771 bp, Homo sapiens
  misc_feature: GZ8MTXP01DUWZK.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcaggttggtgcagacgtggggctggaggtgcagaagccgtggggcatcagtgactgtctcctgcaaggccagtgattatatcttacaactaaatgtaggtatgaagttgggtgacgacgaccggcccccggtaagaagggtcttggaggtgggggtgggggtggtacgaggcggttacgtttagggaacgggtaaggcaacgtagtagtcgaccccgaaccggaaagagaggaaacggggacaaggaacggtacctaaaccgggtaacgtttaaacccccggaacccggtaacccccgaaaccccccgaaacggaaacccttaacctaacgggtttaaccctaaccaagttacgggaacctaaaccgtaacggaaccggaaccgacccggttagggaaacgtccggggtacctaacgggaaccccgggaaaccgtacccggggtacccgttaaccttaagtttaacccgtcgggttacgaaggggtaatttaaccgttttgggttttaacctggttacttacgttaccgttaaacttaagtttagacgttacgttccgtattaacggtcggtagttacggttaaccgttcgggtaaccggggg

SEQ ID NO: 339878 - DNA, 890 bp, Homo sapiens
  misc_feature: GZ8MTXP01B8S9A.17.10.A10.1.454.CMB.2.raw
  modified_base (228)..(228): a, c, t, g, unknown or other
  misc_feature (228)..(228): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcngacaaggcaggtgatatatacttacaataaatataggttatagtagtgggtcgacgacgacggacccccggagaacgggtcttaggaggggttgggggtgggggtgggtacgagggtccgggttcgtttacggggaacgggttaaggcgtaacgtaggtacgtacggaaccccgaaccgggaaagtaacggttacggggaacggggaacgtaaacgggtaacggttacccgtaaaccgggtttaaacccgttaaacccccgggaaacccgggtaaacccccccgaaacccccccggaaacgggtaaacccctaaacccggtaacttaccccgtaaacgtaacggttaaccgaacccgttaaaccgtaccggggaaccgtaaccgggcccgttaaggggaacgaccgggtaaccggtaccgggaaacccggggtaacccgtaacccgggggttaccccttacgtttaaacggtttaccggttacggttaccgggtacgggtaagtttacgttttcgggttttctccgggtttactaaacggtttacccgttaaagtttaacgtttttaggacccgtttaaggggttcctttaacgggttaacgttttacgggggtaaccggtttacgggttaaccgggtttcccgggggttaaccccgggggg

SEQ ID NO: 339879 - DNA, 762 bp, Homo sapiens
  misc_feature: GZ8MTXP01A8A7V.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgacgaggccagtggatatatcttacataaatagtgtatgaacgttgggtgcgacgacgggtccccccggaagaagggtcgttaggacgggtgggggtagggggtgggtcgaggcgggtgtttaggacgggtaaggccagagtatcgacccacggaagagtaggaagggacacggaagtccgaacgtaaccgtaccgaccggacccacccccaaacgggaccaacgtcggtaccatagtcgaccgtaaactagggaaccgagttccggtaagacgggtacgaccggagggaacccgacgtaccccgggggacctttcccgtaaagtttccggtacgtttacgggaaccgtaagggtttaaacgtttttcggggttttaacccttagggtttaccctaaacggtttttaccccggtaaacttttaacggtttaaaggttccgtttaaaccgggggttaactttaacccggttaaggtttaccgggggtaccccgttaagggggtttaacccgttcgggggtttaaaccccggggggg

SEQ ID NO: 339880 - DNA, 634 bp, Homo sapiens
  misc_feature: GZ8MTXP01BUFZN.17.10.A10.1.454.CMB.2.raw
  modified_base (254)..(254): a, c, t, g, unknown or other
  misc_feature (254)..(254): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcacaaatntggtatgaattgggtgcgacgacggcccccggagaagggtcttggaggtggggtgggggtgggtcgaggcgggtcgtttggacgggttaaggcaacgagtacgtcggacccaaccggaagagtggaacggggtaccaaggaacggtaccaacggtactttaacccgaaccgggtacccaaccccccgaacgaaccacgacgtctacagtagaccaactgacgagcctagagagcgtagacgacaacgggtcctcgtaacttacgtgtcgtcgtacgtaattcggttttaactggttactagttacggtaacctaagttttcgacgttacgggtccttagttaagtagggtacttcgggtaacccgttcggtaaccggggg

SEQ ID NO: 339881 - DNA, 678 bp, Homo sapiens
  misc_feature: GZ8MTXP01AN1UY.17.10.A10.1.454.CMB.2.raw
  modified_base (257)..(257): a, c, t, g, unknown or other
  misc_feature (257)..(257): n is a, c, g, or t
  modified_base (584)..(584): a, c, t, g, unknown or other
  misc_feature (584)..(584): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatntaggtatgaattgggtgcgacgacggcccccggagaagggtcttaggaggtggggtgggggtggtcgaggtcggtacgtttgggacggtaaggctacgagttaagtcgacccgaccggaaagagtaggaaggggcaaggaacgtacgaacgtaacgttacccgaaccgggacccaacccccgaacgaaacctacgacttaccaaccgagttacggaccaaacgtggaaccgagacccgtaggacgaacgccgtagggaacccgacgtacccggggtactccgtaagttaccgtggtgtaccggtaagttaagttcggttttaaccgngttacgtaagtttcccgggtaaattaagttttcgagttacgggtaacttacgaaggttcggtacgttcgggtaacgttccggggtaaccggggg

SEQ ID NO: 339882 - DNA, 694 bp, Homo sapiens
  misc_feature: GZ8MTXP01A1VFF.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacatgtgcccacgcccaggttcagttggtgcagactggggctgaggtgcagagccgtgggcatcagtgactgtctcctgacaaggcctagtggatatatcttacacaaatntggtatgaagttgggtgcgtacacggccccggaagaggcgttgaggtggggtggggtggtacgacggtcggtcgtttacggacggttacggacgtacgtagtacgtccggactaacggaagagtagggaaacgggacgaaggtaccgtacgacggaacttaccggaaccggaaccaccccgacgtaaccactacgtactacacgttacgactaacgtcgacggacgaccgagacgtaagggccgtaggaaccgaacgtacccggccgttactaacgtttaccgtggtacggtaccgtaaggttaacgtttcggttttcttaacgggttccttaaacgtttccgttaaaccgttaacggtttgttaaacggtaacggttcccgttaagtttacccgggtaggtttaaacccgtggggttaaccccttttaaccggggg

SEQ ID NO: 339883 - DNA, 704 bp, Homo sapiens
  misc_feature: GZ8MTXP01BXH8L.17.10.A10.1.454.CMB.2.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (629)..(629): a, c, t, g, unknown or other
  misc_feature (629)..(629): n is a, c, g, or t
tcagcgtagactagcacgaccggtgctcgatttagcgtcgatctcaggggacccaaaaatcacacccctccttgggagaatcccctagatcacagctcctcaccatggactggacctggagcatccttttcctggtggcagcaggcacaggtgcccacgcccaggttcagttggtgcagcgtggggctgaggtgcagaagccgtgggcatcagtgactgtctctgcagccagtggatatatctanaactaaatgtggtanaggaagttgggtncgacgaccggcccccgganaagggtcttgggaggttcgggggtgggggtgggtacgacggtcgggttcttttacgggaacgggttaaggacgtacgaaggttactacgggaacccgacgggtaaaggaacgttagggaaaagggtaccgaagggtacgttaacccgaacgtaaaccgttaaccccgaaccgggaaccccaaacccccgaacgaaaccaccgtagtaacctaacgagtacgacctaacgtcgacgacgaccgtagaacgcggtacggaacggaacggacccgtaccggcccgtttcgtaacgtttacgtggtacgtacgttagtaagtttcgttttccttggttacngtttaaccgtaagttatttggaaacgtttcgaccgtttaactagggtcggttacgttcggttaaccggttcgggg

SEQ ID NO: 339884 - DNA, 769 bp, Homo sapiens
  misc_feature: GZ8MTXP01DUNOD.17.10.A10.1.454.CMB.2.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcaggactggggctggaggtgcaggaagccgtggggcatcgagtgactgtctcgtgacaaggcaggtgatatatnttacaactaaatntggtatgaagttgggtcacgacgaccgggtacccccgagaacgggtctaggaggtggggtcgggggtggtacgaggtcggttgtttacgggaacggtaaggcaacgtagtagtacgaccaacggaaagaagtaggaaacggggacaaggtaacgtacgaaaccgtaacttaccggaaccccggaaccaccccgaaagtaaacccgaacgtaacggttaacaacgtacgacggaaccaaacgacggaaccggaagccgtaaggaacggtacgacggggtaaacgaaccggtaccggtaacccgggtcccttaaccgttatttaccggtaggtaccggtaagtaacgggttaattttcgtttttaacgttacgttaacccgtaaggttttaccaaaacgttttaacgtttacgggttaaagtttccggttaaccctttaagtttaacgttaacgggggttaccgtttaccggggttaaccggtttttaaccgggggaaccccgggggg

SEQ ID NO: 339885 - DNA, 708 bp, Homo sapiens
  misc_feature: GZ8MTXP01DJYIQ.17.10.A10.1.454.CMB.2.raw
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (335)..(335): a, c, t, g, unknown or other
  misc_feature (335)..(335): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcaggaagccgtggggcatcagtgactgtctctgcaaggccagtgatatatctananaaatatggtatgaagttgggtgcgacgacgggcccccggagaagggtcgttaggaggtggggtgggggtcggtacgaggcggtnttttagggaaccggttaaggctaacgaggtatagacccgaacggtaaaggagtaacggaaggggaccaagggtaacgtacgtaaacggtaacttaacccgaacccgggaaccccaaaccccccgaacggtaaacccaacgtacggttaccaactacgttagaacctaacgtcggaaaccgacgccgtaaggagacggtacgtcggaaaccgacctaccgggaccttacgttaagtttacgtacgggtcgtacgtaacggttaacgtttcgtttttaaccgtgttactaacggttacgttaaacgttaagtttgttagttacgggttctagtttaacgtgggtacgttagggtaaccgttcgggtaaccggggg

SEQ ID NO: 339886 - DNA, 755 bp, Homo sapiens
  misc_feature: GZ8MTXP01DJ5M1.17.10.A10.1.454.CMB.2.raw
  modified_base (253)..(253): a, c, t, g, unknown or other
  misc_feature (253)..(253): n is a, c, g, or t
  modified_base (491)..(491): a, c, t, g, unknown or other
  misc_feature (491)..(491): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctctgcaaggccagtgatatatcttacanaaatatggtatgaagttggtagcgacgacggcccccggagtaggtcgtggagggtggggtgggggtgggtcaggtcggttcgtttagggaacgggtaagggactagtagtagtacgaccgaccggaaagacggtaggaacggggacaagtggtacgaaccggtaacttaccccggaacggtacccacccccgaaacgaaccacgtaacttacacgtactagaaccgtactggaaccgngtaccgagaacgacgtacggtacgacccggtaaccgaccgggtaccttaccgttagttacgttacggtcggtaccgtaagttaaacgtttttcggttttaaccgtacggttcctttaaacggtttccgtttaaaacggtttaagtttttaacgggttaaccgggtttaaggttaacccccggtttaaagtttaacgggtttaccggggtacggtttacccggggttttaacccggtttccgggggttaaacccccggggggggg

SEQ ID NO: 339887 - DNA, 669 bp, Homo sapiens
  misc_feature: GZ8MTXP01BBAQK.17.10.A10.1.454.CMB.2.raw
  modified_base (250)..(250): a, c, t, g, unknown or other
  misc_feature (250)..(250): n is a, c, g, or t
tcagcgtagactagcacgaccggtgctcgatttagcgtcgatctcaggggacctaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaagccgtggggcatcagtgactgtctctgcaggccagtgatatatcttanaactaaatgtgtatgaagttggtgcgacgacggccccggagaggcttggaggtggggtggggtggtcgaggtcggtcgtttagggacggtaggctacgagtagtgacccgtaccggaagtagtaggaaggacagaacgtacgacgtactacccgaccggacccaaccccgaacgaaccacgtacggtactacgacgtacgaccgtaacgtcggaacgacgaccgaggaacgccggtacgtacggaaccgtaccgtaccgggtccctttacgtaacgtttccgtaggtaggtaaccgtaagttacgttttcgtttaacgtggttacttaacgtttacggtaaacttaaggttttagacgttacgggtcttcgttaaggtcgggtaacgtttcgggtaaccgttttcggggaacccggggg

SEQ ID NO: 339888 - DNA, 654 bp, Homo sapiens
  misc_feature: GZ8MTXP01ADHFK.17.10.A10.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (387)..(387): a, c, t, g, unknown or other
  misc_feature (387)..(387): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgcaaggccagtggatatatcttanaacaaatntggtatgaagttgggtncgacgacggcccccgganaagggtcttggaggtgggggtgggggtggtcgaggcggtcgtttaggacggtaaggcacgagtatcgaccaccggaagagtagggaaggcaggngtcaacgtattacccgacgggaccacccccaagtaaccacacggtactacgacttcgacctaaacgtcgaaccggaacgcccgtaggaacgtacggaccggttacggaacccggaccgtaacccgggtcccggttacttaacgttaccggtaggttacggacgtaacgtaagtttcggttttaactggttactacgttacgtaacttaagtttcgattacgggtcctagtaacgtgggtaccttgggtaacttcgggtaaccggggg

SEQ ID NO: 339889 - DNA, 679 bp, Homo sapiens
  misc_feature: GZ8MTXP01DAQWT.17.10.A10.1.454.CMB.2.raw
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
  modified_base (437)..(437): a, c, t, g, unknown or other
  misc_feature (437)..(437): n is a, c, g, or t
tcagcgtagactagcacgaccggtgctcgatttagcgtcgatctcaggggacccaaaaaccacacccctccttgggagaatccctagatcacagctcctcaccatggactggacctggagcattccttttcctggtggcagcaggcacaggtgcccacgcccaggttcaggttggtgcagacgtggggctggaggtgcaggaaggccgtggggcatcagtgactgtctcctgcaaggcagtggatatatcttacaacaaatatgtatagaagtgggngacgacgacgggccccgagagggtctaggaggtggggtggggtcgggtcagggtcggtcgtttaggacggtaaggcagtagtatacgaccctaacggaagngtaggaaggcaagngtacacgtactaacccgacgacccaccccaagacacagtacctanatcgaactaacgtgacggactaccgtaggaacgaccgtacggtacggaaccggaaccgtacccgggtaccgttaccgtttaacgttacggttacggtacgtaccggtaaagttacggtttttgttttcgtacgttacgggttaacttacgtttaaacgtaagtttttacggaatttaccgggtcttacgttaacgttagggtaccggtttacgggtaaccggtttcccggggtaaccggggg

SEQ ID NO: 339890 - DNA, 980 bp, Homo sapiens
  misc_feature: GZ8MTXP01DMYA9.17.10.A10.1.454.CMB.2.raw
  modified_base (259)..(259): a, c, t, g, unknown or other
  misc_feature (259)..(259): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcaggactggggctgaggtgcagaagccgtggggcatcagtgactgtctcctgacgaaggcagtgatatatctacaataaatntaggtatagaagttgggtcgacgaacgaccgggacccccggagtaaaggggtctttaggagggggttggggggtggggggttacgggggtacgtaacgggtccggggtttacggtttttacggggtaaaccggggtaagggaccgtaaacggttaacgggttacgtaccggggaccccccggttaaaacccggaaaggggtaaggttaacggggaacggggggtaaacccgtaaagggtaacggtaacccgtaaacccggggtaaacccgtttaaaacccccgggaaccccccggggaaaccccccttaaaaccccccccggaaaacgggaaaccctaaacccggggttaaaccgttaacccgttaaaccaaacgtttaccggtaaaccccgaaaccggttaacgggaaacccgggttaaccggccccgttaaaggggaccgtaaccccggggacgttaaaccggggtaaaccccggaaacccggttaccccgggttacccggtttacctttaaaacgttcggtttacggtacggtaccggttaaagttaacgttttttcggttttaacgacggtttaccttaaacggttacgtttaaaccgtttaaggttttaaacccggttggtttaaaaccggtttccgtttaacgtttaacccgggtagggggttttaacccttaccgggggtttcccggtttaacggggggttaaccccggggggg

SEQ ID NO: 339891 - DNA, 719 bp, Homo sapiens
  misc_feature: GZ8MTXP01AG93L.17.10.A10.1.454.CMB.2.raw
  modified_base (251)..(251): a, c, t, g, unknown or other
  misc_feature (251)..(251): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcctanaacaaaatagtggtatagaagttgggtagcgacgacgggcccccggagaagggtcttggacgggtggggtgggggtgggtcgaggccggttgtttagggaaccggttaaggcaacgtagtagtacggacccgaaccggaagtagtagggaacgggaacgaagcggtacgaaccggtaacgtttaaccccgacgggaacccaaccccccgaacggaaacccacgtaacggtacctaacgacgaggaccaacgtacgacggactccgagaggacgacgggtacggaaccgaccgtaccgggtacccgttacttacgttaacgtgtacggtagtaacgggttaatttcgggttttaactcgggttaactacgtttacgggttaaaccttaagttttcggttaaggttaccggttcgttaaccgttgttacgggtaacgtttcggggttaacgttcggggtaacccgggggg

SEQ ID NO: 339892 - DNA, 708 bp, Homo sapiens
  misc_feature: GZ8MTXP01AGUNV.17.10.A10.1.454.CMB.2.raw
  modified_base (498)..(498): a, c, t, g, unknown or other
  misc_feature (498)..(498): n is a, c, g, or t
  modified_base (552)..(552): a, c, t, g, unknown or other
  misc_feature (552)..(552): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcagagcgtgggcagtcgagtgactcgtctccgtgaccgaacggaccgagtggattatactccttacaactaaagtagtaggtatacgtaagttcgggtacgacgaccgaccgggacccccggaagacgggttacgttgggagggttcgggggtgggggtcgggtacgtgggtacggtcgtttacgggaacggtaggaccgagtagtagcgaccgacggaggtagacgggacggacgagaacgtacgaacgtacgtaccccgaccggaaccacccctaacgaactaccgcgtacaactacgtnaaccgaacgtcggaacgttacggaccttagaagtaccgacggacggggtaaccncgtacccgggtactgttacctgtacggtcgtacgagtttagtttcgttggtaacttccttaaagggttctttaacggtagtttcgttaaggttccgtttgaaccgtttgggtacccgggtaggtttacccgggtaaccggttcgggggtaaccggg

SEQ ID NO: 339893 - DNA, 698 bp, Homo sapiens
  misc_feature: GZ8MTXP01CNOY6.17.10.A10.1.454.CMB.2.raw
  modified_base (274)..(274): a, c, t, g, unknown or other
  misc_feature (274)..(274): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtcgcccacgcccaggttcagttggtgcgagacgtggggctggaggtgcgagaagccgtggggcagtcagtgactgtctctgcaggcagtgatatatctacaacaaatagtaggtatagagtggngcgacgacggccccgagaggtctggagggtgggtggggtgcgagtcggtcttaggacggtagcagagtntcgaaccgtacggaagngtacggaagggtacgaacgggtaacgtacgaacgtaaccgtaccgaacccgggaccccaacccccgaacgaaacctcgtaacgtacctaacgatacggacgtaaacaggaccgtacgtaccgaggaacgtaccggacggttacggaaacccggaccggtaaccccgggttacctaacgttaccgttacggtacggtccgtaaggtaacggtttaacttttcgtttaacccgttgaccggtttaacgttacgttaaacgtttagtttaggggttacttacggtaacttaccgttaaggtaaccggtcgttacgggttcccggttggggtaacccggggg

SEQ ID NO: 339894 - DNA, 736 bp, Homo sapiens
  misc_feature: GZ8MTXP01BXR5N.17.10.A10.1.454.CMB.2.raw
  modified_base (639)..(639): a, c, t, g, unknown or other
  misc_feature (639)..(639): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggcgtggaggtgcgaggaagccgtggggcatcgagtgactgttctcctgacgaggccaggtggatatatcttacaataaatagtggtatagaagttggggtacgcgtaaccacgggtcccccggaacgaaggggtcttgggagggtgggggtggggggtggtacgacgggtcggtccgtttagggtaacgggtaagggtccacgtaagttacggtacgccccgaaaccgggaaagtaaggttaacgggaacgggggacctaaggtaaggttacccgaaacggtaaactttaaccccccgaacggaacccccgacccccaaacggaactacgacgttacacctaagtcgaacctaagacgacgtacgcctggaagaccgtcgacggtaaccggacggaccggtcgttaccctagttacgtacggttgacccgggtaaattacgtttcggttttcncgggttactaggttaacctagttaagttttacgagtttacgtcgttaaaccttcggttaaggcgtttaccgggtaacgtttccggggtaaccggggg

SEQ ID NO: 339895 - DNA, 714 bp, Homo sapiens
  misc_feature: GZ8MTXP01E1DDG.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtgcccacgcccaggttcagttggtgcagactggggctgaggtgcagaagccgtggggcatcagtgtactcgttcctcctgacgaaggccaggtggattatattcttacaactaaatagtaggtatagtaagttgggtcgacgaccgaccgggacccccggaggaacgggtcttaggaggggtgggggtggggggtgggtccgaggcggttcgtttaggaacggtaggcaacgagtatcgaccccgaaccggaaggtagtaggggaaggacgaggaacgtacgaacgtactaacccgaccgaccccaacccccgaacgaacccacgtacgtacctacgactacggaaccctaacgtacggaccgacggacccgtagggaaacgcggtacccgtacgggaacccggaccgtacccggggtccctttacgttacgttccgtagggtcgtacggtaacgtattttcggttttaaccgtgttacgacgtttacgttaaacctaatttggacttacggtcttacgtaaggtcggtaattcggggtaaccgtttcggggaaccggggg

SEQ ID NO: 339896 - DNA, 513 bp, Homo sapiens
  misc_feature: GZ8MTXP02JWHYC.17.10.A10.1.454.CMB.2.raw
  modified_base (366)..(366): a, c, t, g, unknown or other
  misc_feature (366)..(366): n is a, c, g, or t
  modified_base (469)..(469): a, c, t, g, unknown or other
  misc_feature (469)..(469): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccggacaagggcttgagtgggtggggtgggtcgagcggctttgacggtaaggcacagtatgccaccgaagatgaaggggcagngtcacgattaccacggacacccccacgaacacagtctacatgcaactgacgagccctgagagctgacgacacgggccgtctattactgtgcgagaatgtttcngtcatcgtacatttgataggctctatgactggacttcgtcgggg

SEQ ID NO: 339897 - DNA, 536 bp, Homo sapiens
  misc_feature: GZ8MTXP02H7ACO.17.10.A10.1.454.CMB.2.raw
  modified_base (259)..(259): a, c, t, g, unknown or other
  misc_feature (259)..(259): n is a, c, g, or t
  modified_base (343)..(343): a, c, t, g, unknown or other
  misc_feature (343)..(343): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccaatcgttggattcaattangtgtcctggtaccagcaactcccgggatcacgcccccaaactcctcatatatgaagataataagcgaccctcaggggttccccngaccgatctctggctccaaagtctgcacgtctgccaccctggcatcaccgngctccagacctggggacaggccgagtatttcgngcacaacngtacggacttccgagtcctagtacgttcggtggggttcgttcggactagggtcggaaccagtcgtacgaaccgtcgtacggcacgacccgaaggtcctccg

SEQ ID NO: 339898 - DNA, 522 bp, Homo sapiens
  misc_feature: GZ8MTXP02GYMD2.17.10.A10.1.454.CMB.2.raw
  modified_base (288)..(288): a, c, t, g, unknown or other
  misc_feature (288)..(288): n is a, c, g, or t
  modified_base (370)..(370): a, c, t, g, unknown or other
  misc_feature (370)..(370): n is a, c, g, or t
  modified_base (474)..(474): a, c, t, g, unknown or other
  misc_feature (474)..(474): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcaggcgggctttggacggtaaggcacgagtatgccaccgaagatgaaggggcagngtcacgattaccacggacacccccagaacacagtctacatgacaactgacgagcctgagagctgacgacacgggccgtctattactgtagcgagtatgttttcngtcatcgtactaatttgataggctctagtcgactggacttcgtcgggg

SEQ ID NO: 339899 - DNA, 521 bp, Homo sapiens
  misc_feature: GZ8MTXP02IWS1J.17.10.A10.1.454.CMB.2.raw
  modified_base (289)..(289): a, c, t, g, unknown or other
  misc_feature (289)..(289): n is a, c, g, or t
  modified_base (364)..(364): a, c, t, g, unknown or other
  misc_feature (364)..(364): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaaattgggtgcgacaggcccccgganaagggcttgagtgggtggggtgggtcagcggctttgacggtaaggcacagtatgccaccgaagatgaagggcagngtcacgattaccacggacacccccagaaacacagtctacatgacaactgacgagcctgaacgagactgaacgacacgggccgtactattactgtgcgagaaatgtttactgtcatcgtacaatttgataggctctatggactggacttcgtacgggg

SEQ ID NO: 339900 - DNA, 594 bp, Homo sapiens
  misc_feature: GZ8MTXP02ISJ27.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaacccccatgtgattcaatatgtgtctgtaccagcaactcccggatcacgcccccaaactcctcatatatgaagataataagccgaccctcgacggggttcccctcgaccgtattcctctcggctccaagtctgggcctacgtctcgcccacccgtgggccatccacccgcgcctcccgagaccgtgggggaccgagggcccgaagttactttcgtgccgacaaacgagtggggacttccgagtccttagtacgttcggttgggggttcgtttcgggcgtacgggttacggggaccctaaaggccgttacggaaccccgttcccgtaagggtcccacggacccccgaacggggcccttccccgg

SEQ ID NO: 339901 - DNA, 679 bp, Homo sapiens
  misc_feature: GZ8MTXP02GO9NL.17.10.A10.1.454.CMB.2.raw
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttnaacaaaatatggtatgaattgggtgcgacaggcccccgganaagggcttgaggtgggtggggtggctcgaggcggctttggacggtaaggcacagtatcgacaccgaagagtggaagggcaggagtacaacggtacttacccgaacggacccaaccccccaaaccgaaaccaaccgaacgtacctaaacaacgttacgacctaaaaccgtggaaccgacgtaccccgtaggaacggaaacggcccgttaacgggaacccgaaacccggaaccggggacccgttaccttaagtttaacccgtgggttacggaccggtaaagtaaaacgtttggtttttaccctaggtttacccgtaattaccggttaaacctaaagttttagaaagtaacggtctacttaagtcggtaaccgttgggtaacctttcggggg

SEQ ID NO: 339902 - DNA, 510 bp, Homo sapiens
  misc_feature: GZ8MTXP02IOSMV.17.10.A10.1.454.CMB.2.raw
  modified_base (372)..(372): a, c, t, g, unknown or other
  misc_feature (372)..(372): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgtggcccccggacaggaggtcaccatctcttgctctggaaaccccccaatgttggattcaattatgtgtcctggtaccagcaactcccggatcagcccccaaactcctcatatatgaaagataatagcgaccctcaggggttcccctgaccgattctctggctccaagtctggcacgtcngccaccctggcatcaccgcgctcccagactggggacgaggccgagttacttctgcgcaacatgggattccagcctgacttcgtggggtgttcggctagtgggaccaagctagaaccgtctacgtcagcccaggctccg

SEQ ID NO: 339903 - DNA, 677 bp, Homo sapiens
  misc_feature: GZ8MTXP02GT7BX.17.10.A10.1.454.CMB.2.raw
  modified_base (293)..(293): a, c, t, g, unknown or other
  misc_feature (293)..(293): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacgacggcccccggaanaacgggcttggagggtggggtgggggtgggtcaggtcggtcgtttggacgggtaaggcaacgagtatgacccgaaccgaagagtaggaaaggggcaaggacgtcaacggtacttaacccgaccgggaaccaaccccccgaagaaaccacacgtacctaacagtacgaccaacgtgaacgacgacccgtaggagagccgtacggaaccgaaccgaccgggacccgttaccttaagtttaccgtggtcggtaaccggtaagtaaaagtttcggtttttacctaggttacctaagttacccgttaaacttaaacgtttttacggaagtttaacggctttacgttaagtcgggtaaaccgttgggtacccttttcgggtaaccggggg

SEQ ID NO: 339904 - DNA, 540 bp, Homo sapiens
  misc_feature: GZ8MTXP02IIAD5.17.10.A10.1.454.CMB.2.raw
  modified_base (364)..(364): a, c, t, g, unknown or other
  misc_feature (364)..(364): n is a, c, g, or t
  modified_base (450)..(450): a, c, t, g, unknown or other
  misc_feature (450)..(450): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaaattgggtgcgacaggcccccggacaagggcttgaggtggggtggggtgggtcagcggctttgacggtaaggcacagtatgccaccgagatgaaggcagngtcacgattaccacggacaccccacgaacacagtactacatgacaactgacgagcctgagagctgacgacacggccgtctattacngtgcgagtaattgttttactggttacattaccgtaactaagtttacgattaaggcttactagttcggaactcggtactttcggacggggg

SEQ ID NO: 339905 - DNA, 522 bp, Homo sapiens
  misc_feature: GZ8MTXP02GL6J2.17.10.A10.1.454.CMB.2.raw
  modified_base (364)..(364): a, c, t, g, unknown or other
  misc_feature (364)..(364): n is a, c, g, or t
  modified_base (452)..(452): a, c, t, g, unknown or other
  misc_feature (452)..(452): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccggacaagggcttgagtgggtggggtggtcagcggctttggacggtaaggcacagtatgccaccgaagatgaagggcagngtcacgattaccacggacacccccagaaaccacagtctacatgcaactgacgagcctgagagctgacgacgacgggccgtctattacngtgcgagaattgtttactgtcctatcgtactaatttgattaggctctagtcgactggacttcgtacgggg

SEQ ID NO: 339906 - DNA, 608 bp, Homo sapiens
  misc_feature: GZ8MTXP02JYKMO.17.10.A10.1.454.CMB.2.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacacggcccccgganaagggcttgaggtggggtggggtgggtcaggcggctttggacggtaaggcacgagtatgccacgaagagtaggaagggcagngtcacgataccacggaccacccccagaacacagtctaacatgacaacgtgaacgagcctagagagctagacgacgacgggccgtactacttactggtcgacgtagtaagttgttttacgtggttactacgttaccggttaacttaaacgttttaggtaacgtttaacgggtcctttaccgtttaaggttacggggttaaccgttcgggttaacccggttttcgggtaacccgggggg

SEQ ID NO: 339907 - DNA, 547 bp, Homo sapiens
  misc_feature: GZ8MTXP02JU0X7.17.10.A10.1.454.CMB.2.raw
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccatgttggattcaattatgtgtcctggtaccagcaactcccggatcacgcccccaaactcctcatatatgaagataataagcgaccctcgaggggttcccctgaccgattctctggctccaagtctggcacgtctgcccaccctggcatcaccgcgctccagacgtggggacaggccgagtatttcgngcgacaacgngtggtacttccgacgtcctgtacgttcggtcggggttcgttcggcgtagggtcggaaccacgtcgtacggaacccgtcgtacggtaccacggacccgtaacggccgtccg

SEQ ID NO: 339908 - DNA, 519 bp, Homo sapiens
  misc_feature: GZ8MTXP02GE5OX.17.10.A10.1.454.CMB.2.raw
  modified_base (367)..(367): a, c, t, g, unknown or other
  misc_feature (367)..(367): n is a, c, g, or t
  modified_base (496)..(496): a, c, t, g, unknown or other
  misc_feature (496)..(496): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcaccaggtgcccacgcccaggttcagttggtgcagactggggctgaggtgcagaagcctggggcatcagtgactgtctcctgcaaggccagtggatatatcttcacaaaatatggtatgaattgggtgcgacaggccccccggacaagggcttgagtgggtggggtggggtcaggcggctttgacggtaaggcacagtatgccaccgaagatgaagggcagngtcacgattaccacggacacccccacgaaacacagtctacatgacaactgacgagccctgagagctgacgacacgggccgtctattactgtgcgagaattgtttctgtcatccgtacaatttgataggntctatggactggacttgtcgggg

SEQ ID NO: 339909 - DNA, 516 bp, Homo sapiens
  misc_feature: GZ8MTXP02GEQQH.17.10.A10.1.454.CMB.2.raw
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtgggtcagcggctttgacggtaaggcacagtatgccaccgaagatgaagggcagngtcacgataccacggacacccccagaaacacagtctaacatgacaactgacgagcctgagagctgacgacacgggcctctatactgtgcgagaatgtttactgtcatcgtaacaatttgattaggctactatggactggacttcgtacggggg

SEQ ID NO: 339910 - DNA, 552 bp, Homo sapiens
  misc_feature: GZ8MTXP02G5CZH.17.10.A10.1.454.CMB.2.raw
  modified_base (289)..(289): a, c, t, g, unknown or other
  misc_feature (289)..(289): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttgaggtggggtggggtgggtcaggcggctttggacggtaaggcacagtatgaccaccgaagatgaagggcagngtcacgataccacggaccacccccagaacacagtctacatgacaactgaacgagaccctgagagctagacgacacgggcctactattacgtgtgcgtaagaattgttttactgtctacttcgtaactaagtttagaagttacggtcttactagtacggtacctaggtactttcggtacggggg

SEQ ID NO: 339911 - DNA, 586 bp, Homo sapiens
  misc_feature: GZ8MTXP02HUHXC.17.10.A10.1.454.CMB.2.raw
  modified_base (427)..(427): a, c, t, g, unknown or other
  misc_feature (427)..(427): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggccccggacaggaggtcaccatctcttgctctggaaaccccccaatgttggattcaattatgtgtcctggtaccagcaaactcccgggatcacgcccccaaactcctacatatatgaagataataaagcgtaaccctcacggggttcccctagaccgattcctcttcggctccaaagttctagcacgtctgcccaccctgggcagtcaccgcgctccgagacgtggggacgnggccgtaggtatttcgtgcgacaactgtcgggattccgagtcctagacgtttcgtgggggttcgtttcggacgacggttacggggacccaaaggccgttcggaaacccgttccgtaacggggttaccacggtacccccgaaaggggtccctaccccggg

SEQ ID NO: 339912 - DNA, 563 bp, Homo sapiens
  misc_feature: GZ8MTXP02GG4DN.17.10.A10.1.454.CMB.2.raw
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccaatgttggattcaattatgtgtcctggtaccagcaactcccggatcacgcccccaaactcctcatatatgaaagataataagcgaccctcgaggggttcccctgaccgattctctggctccaagtctggcacgtctcgcccacccgtgggccatccaccgcgctccagacgtggggacgaggcccgagtatttcgngcgcaaacngtgggattccagtcctgacttcgtgggggttcgttcggctaaggtcgggaacccaaagccgttaggaacccgttccgtaaggggtccaacggacccccgaaagggtcccttccccggg

SEQ ID NO: 339913 - DNA, 562 bp, Homo sapiens
  misc_feature: GZ8MTXP02HBBE8.17.10.A10.1.454.CMB.2.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (446)..(446): a, c, t, g, unknown or other
  misc_feature (446)..(446): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaccccccatgtgattcaatntgtntcctgtaccagcaactcccggatcacgcccccaaactcctcatatatagaagataataagccgaccctcgacggggttcccctgaccgtattctctggctccaagtctggccacgtctcgcccacccgtggcatcaccgcgctccgagacgtggggacgaggccgagttatttcgtgccgacaaaccgngtcggggactttcccgagcccttagacgtttcgtgggggtcgtttcgggctagggtcgggaccaacgtccgtaggaacccgtcgtacgggtccacggccccgaacggcctccccgg

SEQ ID NO: 339914 - DNA, 613 bp, Homo sapiens
  misc_feature: GZ8MTXP02HZPTM.17.10.A10.1.454.CMB.2.raw
  modified_base (305)..(305): a, c, t, g, unknown or other
  misc_feature (305)..(305): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatcgttggattcaattatgtgtcctggtaccagcaaccgtccggatcacgcccccaaactccncatatatagaagataaataagaccgaccctcgacgggttcccctagaccgtattctctggctcctaagtctcggcacgtctcgcccacccgtgggactactcccgacccggccgcctacccgacggaccggtacgggggaccgaacgggcccgtaagttactttcgtgaccggacaacgtagtacggggactttccgacgtcccgtagtaccgttcggttgggggttcgtttccgggctacggggtcggaacccaggtccgtacggaacccgtcgtacgggtccacgaccccgaaggtccctccccgg

SEQ ID NO: 339915 - DNA, 527 bp, Homo sapiens
  misc_feature: GZ8MTXP02JGZ7S.17.10.A10.1.454.CMB.2.raw
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggtggggtggggtcaggcggcgtttggacggtaaggcacagtatgccaccgaagatgaagggcagngtcagattaccacggacacccccacgaaacacagtcacatgacaacctgacgagaccctgagagactagacgacgacgggccgtctaattactgtgcgagaatgtttctgtcatcgtactatttgataggctctatcggactggtacttcgtcggggg

SEQ ID NO: 339916 - DNA, 555 bp, Homo sapiens
  misc_feature: GZ8MTXP02F2ZEP.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaacccccatgtgatcatatgtgtctggtaccagcaactcccggatcacgcccccaaactcctcatatatgaagataataagcgacctcgagggttcccctgaccgattctctggctccaagtctggcacgtctcgcccacccgtggcactcaccgcgctccagacgtggggacgaggcccgagttatttcgtgccgacaaacgagtggggaactttcccgagtccctagtacctttcggtgggggttcgttcgggccgtaagggtcgggaccctaaggccttacggaacccgtccgtacggtccacgcccgaaggccgtcccgg

SEQ ID NO: 339917 - DNA, 536 bp, Homo sapiens
  misc_feature: GZ8MTXP02FR7SQ.17.10.A10.1.454.CMB.2.raw
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattggggtgcgacaggcccccgganaagggcttgaggtgggtggggtgggtcaggcggctttgacggtaaggcacgagtatgccaccgaagatggaagggcagngtcacgattaccacggaccacccccagaaacacagtctaacatgacaactgaacgagcctagagagctagacgacgacgggccgtactattacgtgtcgacgtagtaagttgttttactgtcatcgtgactaatttgataaggctactagtgacgtggtactttcgg

SEQ ID NO: 339918 - DNA, 580 bp, Homo sapiens
  misc_feature: GZ8MTXP02H58EE.17.10.A10.1.454.CMB.2.raw
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (435)..(435): a, c, t, g, unknown or other
  misc_feature (435)..(435): n is a, c, g, or t
tcagcgtagactagcacgaccggtgctcgatttagcgtcgatctcaggggacccaaaaaccacacccctccttgggagaatccccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgaggcccccggagaacgggctggaggtgggnggggtgggtcgaggcgggtctttggacggtaggcaacgagtatgccacgaagagtgaagggcagngtcaacgacttaccgaccggaccaacccccaacgaaaccacagtactacatgacaaaccgngacgacgtactagacgctacgacgacgacggctactagtacgtgtacgacgtagtagtttcgtttactcgtactagtacgtaagttaacgttacgacgttagacttaacgtagtacggtacgtacggtacgttcggtacgggacg

SEQ ID NO: 339919 - DNA, 616 bp, Homo sapiens
  misc_feature: GZ8MTXP02G5L1X.17.10.A10.1.454.CMB.2.raw
  modified_base (377)..(377): a, c, t, g, unknown or other
  misc_feature (377)..(377): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggccagtggatatatcttacacaaaatatggtatgaattgggtgcgacacggcccccggacgaaggcttgaggtggggtggggtgggtcgaggcggtcgtttggacgggtaaggcacgagtatgccaccgaagagtagaggcagngtcgaacgattaccacggaccaccccgacgaaacacagtactaacatgacaacgtgaacgacgaccgtagagagcgagacgaccgacgggccgtactacttaacgtgtacggtacgagtaaagtttacggttttacttcggttactacggttaccctaaacgtttaacgtttacgtaagttagggtaacccgttattaacgtaggtaacgttacgggtaaccgtttcggtaaccggggg

SEQ ID NO: 339920 - DNA, 616 bp, Homo sapiens
  misc_feature: GZ8MTXP02GXCOV.17.10.A10.1.454.CMB.2.raw
  modified_base (289)..(289): a, c, t, g, unknown or other
  misc_feature (289)..(289): n is a, c, g, or t
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttggaggtggggtggggtgggtcgaggcggtctttggacggtaaggcacgagtatgccaacgaagagtaggaaggggcaaggngtacaacgtaacttaccgaccgggaaccaccccccgaaacgaaaccacacgtactaacatacgacaaactgaacgaagccctgaagagactaggaaccgaccgacgggccgtacttaagttacctggtacgacggaagtaattgttttctggttactacttacggttaactaagttttacgaagttaggtaacttcgttaacgtaggtaacgtcggtaaccgttttcggtaccggggg

SEQ ID NO: 339921 - DNA, 651 bp, Homo sapiens
  misc_feature: GZ8MTXP02JTRNH.17.10.A10.1.454.CMB.2.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaattgggtgcgacaggcccccgganaagggcttgaggtggggtggggtggtcgaggcggtctttggacggtaaggcacgagtatgaccacgaagataggagggcagcgtcacgtataccgacggaccacccccgagaaccacagtactacatcgacaactcggaacgacgacccgtagaacgacgccgtacggaccgaaccgacccgggtacccgttacgttaacgtttaaccgttggttacggaccggtaaagttaaagtttcggttttttcgtacggtttacctaaacgtttaccggttaaaccttaaacgtttttacggaagtttacgggtccttacgttagtacgggtaaccgtttgggtacccgtttcgggttaccggggg

SEQ ID NO: 339922 - DNA, 544 bp, Homo sapiens
  misc_feature: GZ8MTXP02JW2N2.17.10.A10.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcaggcggtcgtttgggacggtaaggcacagtatgccaccgaagatgaaggcagngtcacgataccacggaccacccccagaacacagtctacatgacaactgacgagcctgagngctgacgacacgggaccgtctagttacgtgtgcgtagtaattcgttttcngttcagttacgtactaagtttcgagttaggcttcgtagtcggtactcggtacgttcgtacggggg

SEQ ID NO: 339923 - DNA, 706 bp, Homo sapiens
  misc_feature: GZ8MTXP02JUYVD.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgtaagttgggtgcgacgacgggcccccggagaacgggcttggaggtggggtgggggtggggtcgaggcggtcgtttgggacgggttaaggcacgagtagtgacccgaccgaagagtaggaaggggcaaggaggtacaacggtacttacccgacgggaacccaacccccgaacggaaaccaccaacgtacctaacatcgacaaccgtgaaccgacgcccgtaggacgagccgtacggaaccggacgaccggggtcccgttacttaacgtttacgtcggttacggcggtaagtaacgtttcggtttttcgtacggttaccgtaacgtttaccggttaaacctttaaacgttttaggtaaacgtttacggggtaacctttaccgttaaggttacggggtaaaccgtttcggggttaaaccggtttttcggggtaacccgggggg

SEQ ID NO: 339924 - DNA, 551 bp, Homo sapiens
  misc_feature: GZ8MTXP02FZUZY.17.10.A10.1.454.CMB.2.raw
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgcaaggccagtggatatatcttcacaaaatatggtatgaattgggtgcgacaggcccccggacaagggcttggaggtggggtggggtgggtcaggtcggctttgacggtaaggcacgagtatgccaccgagatgaaggcagngtcacgataccgacgacacccccagaacacagtacacatgacaactgacgagcctgagagctggacgacgacggccgtactattactgtcgacgagtaattgttttactgtactacttcggtaaactacgtttagaatttaaggcttacgtaagtcggtacttcggtacgtttcgtacggggg

SEQ ID NO: 339925 - DNA, 557 bp, Homo sapiens
  misc_feature: GZ8MTXP02HEH1O.17.10.A10.1.454.CMB.2.raw
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtgggtggggtggggtcaggcggctttggacggtaaggcacagtatgccaccgaagatggaagggcagngtcacgattaccacggacacccccagaaccacagtctacatgacaactgaacgagacctgaagacgctgaaccgacgaaccgggccgtacgtacttacctggttacgcgtaagaaattggttttactggttctactcgtaactaagttttagacttaggctactagtggacttggtacttcgtacgggg

SEQ ID NO: 339926 - DNA, 517 bp, Homo sapiens
  misc_feature: GZ8MTXP02JRF7U.17.10.A10.1.454.CMB.2.raw
  modified_base (363)..(363): a, c, t, g, unknown or other
  misc_feature (363)..(363): n is a, c, g, or t
  modified_base (466)..(466): a, c, t, g, unknown or other
  misc_feature (466)..(466): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgccaccgaagatgaagggcagngtcacgattaccacggacacccccacgaacacagtctacatgcaactgacgagcctgagagctgacgacacgggccgtctattactgtgcgagaatgttttcngtcatcgtactaatttgataggctctatcggactggtactttcgtcggggg

SEQ ID NO: 339927 - DNA, 589 bp, Homo sapiens
  misc_feature: GZ8MTXP02HMOIN.17.10.A10.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccggacaggaggtcaccatctcttgctctcggaacccccatgtgatcatatgtntctgtacngcactccggatcacgccccaactcctcatatatagaagataataagccgaccctcgtacggggttcccctgaccgtatttcctcgtacggtcctccgtaagttcgtcggcctaccgtcctacgcccctacccgtgggccacgtccgacccgcgaccttccgaacgtaccggtgggggaccgacgggaccgtaacggtttactttccgaggccgacaaacgtagtcggggtaacttcccgagtccctagtcgttcggtggggttcgtcggcgtagggtcgggaccaggtcctaggaaccgtcgtacggcacggcccaaggtcctcccgg

SEQ ID NO: 339928 - DNA, 532 bp, Homo sapiens
  misc_feature: GZ8MTXP02GA28A.17.10.A10.1.454.CMB.2.raw
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcgaggcggctttggacggtaagggcacagtatgccaccgaagataggaaggggcagnggtcaacggattaccgacggaccacccccaacgaaccacacgtctacatgacaactgacgagcctgaagagctgacgacacgggcctactattactgtgcgtagaattgtttctagtcatcgtactattgatagctntatcgactggacttcgtacgggg

SEQ ID NO: 339929 - DNA, 534 bp, Homo sapiens
  misc_feature: GZ8MTXP02HJIUW.17.10.A10.1.454.CMB.2.raw
  modified_base (369)..(369): a, c, t, g, unknown or other
  misc_feature (369)..(369): n is a, c, g, or t
  modified_base (477)..(477): a, c, t, g, unknown or other
  misc_feature (477)..(477): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgaggtggggtggggtgggtcgagcggctttggacggtaaggcacgagtatgccaccgaagatggaaggcagngtcacgataccacgaccacccccacgaaacacagtctaacatgacaactgacgagcctgagagctagacgacacggccgtctattactgtgacgataattgttttacnggtctatacgttactaagtttcgattagctgtagtggactggtactttcgtcggggg

SEQ ID NO: 339930 - DNA, 621 bp, Homo sapiens
  misc_feature: GZ8MTXP02HNHQX.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccatgttggattcaattatgtgtcctgtaccagcaacgtcccggatcacgcccccaaactcctcatatatagaagataataacgcgaccctcgagggttccccagaccgtattctcgtcggctccgaagtctaggccacgtctcgccccacccgtgggaccatccacccgccgctcccgagaccgtgggggaccgacgggcccgtagttactttccgtcgaccggtaccaaaccgtagtacggggtactttacccgaggtccccttaggtacctttcgggttcgggggttcgtttaccggcgtaacgggttcggaccgagtcccgtaggaaccccgttacggtacggtaccgacggtaccccgaagggtcccttcccccggg

SEQ ID NO: 339931 - DNA, 535 bp, Homo sapiens
  misc_feature: GZ8MTXP02JU3Y7.17.10.A10.1.454.CMB.2.raw
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaaatatggtatgaattgggtgcgacaggcccccggacaagggctttgaggtgggtggggtgggtcgagcggctttggacggtaaggcacagtatgccaccgaagatgaagggcagagtcacgattaccacggacacccccacgaaacacagctacatgcaactgacgagccngagagccgngacgacacggccgtctattactgtgcgagaatgtttcttgtctactcggtactaattagtataggtcgtcttactcggtagtacggtacgttcgttccggggg

SEQ ID NO: 339932 - DNA, 586 bp, Homo sapiens
  misc_feature: GZ8MTXP02F8LD6.17.10.A10.1.454.CMB.2.raw
  modified_base (380)..(380): a, c, t, g, unknown or other
  misc_feature (380)..(380): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatataggtatgaattgggtgcgacgacggcccccggagaagggcttggaggtggggtggggtgggtcgaggtcggcgtttggacggtaaggcacgagtagtgccgaccgaagataggaaggcagngtcacgataccgacggacacccccagaacacagtactacatgacaacgtgacgacgaccgtagagagcgtacggacgaccgacgggcctacgtacgttactggtacgcgtaagtaattgtttctaggttcctattacgttaactaagtttcgaagttacggcttacgtaagttacggtacgttcggtaccgtttcggtaccggggg

SEQ ID NO: 339933 - DNA, 556 bp, Homo sapiens
  misc_feature: GZ8MTXP02GVKC5.17.10.A10.1.454.CMB.2.raw
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
  modified_base (507)..(507): a, c, t, g, unknown or other
  misc_feature (507)..(507): n is a, c, g, or t
  modified_base (534)..(534): a, c, t, g, unknown or other
  misc_feature (534)..(534): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattggggtgcgacacggcccccggagaaagggcttggaggttggggtggggtgggtcaggtcgggtctttaggacggtaaggcaacaggtatgccaaccgaagataggaagggcaagngtcaacgattaccgacgaccacccccagaaccacagtcaacatgactaaacngaacgagcctagagagctgaacgacgtaccgggaccgtactacgttactcggtagcgagtaaattgtttacngtctatcgtaatatttgataggcttanagtcgactggaccttgtcgggg

SEQ ID NO: 339934 - DNA, 556 bp, Homo sapiens
  misc_feature: GZ8MTXP02GBETA.17.10.A10.1.454.CMB.2.raw
  modified_base (373)..(373): a, c, t, g, unknown or other
  misc_feature (373)..(373): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacgaagggcttgaggtggggtggggtgggtcgaggcggcgtttggacggtaaggcacgagtatgccaccgaagatagaagggcagngtcacgattaccacggaccacccccacgaaacacagtctacatgacaactgaacgagacctgagagctagacgacacgggccgtactattactgtgacgagtaattgtttactgtacacttacgttaactaagtttacgataggtcttacgtagtcggtacgtaggtacctttcgtacggggg

SEQ ID NO: 339935 - DNA, 576 bp, Homo sapiens
  misc_feature: GZ8MTXP02HDTIL.17.10.A10.1.454.CMB.2.raw
  modified_base (289)..(289): a, c, t, g, unknown or other
  misc_feature (289)..(289): n is a, c, g, or t
  modified_base (375)..(375): a, c, t, g, unknown or other
  misc_feature (375)..(375): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (506)..(506): a, c, t, g, unknown or other
  misc_feature (506)..(506): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttgaggtggggtggggtgggtcaggcgggctttggacggtaaggcacgagtatgccaccgaagagtaggaaggggcaagnggtacaacggacttacccgacgggaccacccccaacgaaaccacacgtactacatgacaactcgacgagccctgaacgngactggacgacacggccgtntagttactgtagcgtagtaattcgttttacgngtactacgttacgtaactacgttagacgtacgtcttacgtagtacgtagtacggtacgttacggtcgggg

SEQ ID NO: 339936 - DNA, 570 bp, Homo sapiens
  misc_feature: GZ8MTXP02JFKG6.17.10.A10.1.454.CMB.2.raw
  modified_base (372)..(372): a, c, t, g, unknown or other
  misc_feature (372)..(372): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgtaattgggtgcgacacggcccccggagaagggcttgaggtggggtggggtggtcgagcggtcgtttggacggtaaggcacgagtagtgccacgaagataggaaggcagngtcacgattaccgacgaccacccccgagaaacacagtctacatgacaactgacgagcctgagagctagacgacgacgggccgttactaacgttacgtggtcgcgtaagtaattgttttccgtgttactacttaccgtaacttaagttttagaagttaggtcttacgtagttggacgttggtaactttcggtacggggg

SEQ ID NO: 339937 - DNA, 585 bp, Homo sapiens
  misc_feature: GZ8MTXP02IJWIL.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctacggaaaccccccaatgttggattcaattatgtgtcctggtaccagcaacgtcccggatccacgacccccaaactcctacatatatagaaagaataaataagccgaccctcgaggggttcccctagacccgtattctctcggtctccaagtctggccacgtctcgcccacccgtggaccactccgaccgcgctcgaagacgcggggacgaggaccgagttatttcgtgccgacaacgagttgggaacttccgacgtcgtacgtacgttcggtggggtcgttcggctaagggttcgggaaccgtaacgccgtacgtaacccgtacgtacggaccacgaccccgaaggtccctcccgg

SEQ ID NO: 339938 - DNA, 555 bp, Homo sapiens
  misc_feature: GZ8MTXP02G8OAZ.17.10.A10.1.454.CMB.2.raw
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcacaaaatatggtatgaattgggtgcgacaggcccccgganaagggcttgaggtggggtggggtgggtcaggcggctttggacggtaaggcacgagtatgccaccgaagagtaggaaaggggcaaggagtcaacgaacttaacccgacggaaccacccccaacgaaaccacaagtcctaacatcgcaaactgaacgagccctaggagagctagacgacacggggcctactaattactgtcgacgaagtaattgttttctgtcatcgtaactattgataggctctatcggactggactttcgacgggg

SEQ ID NO: 339939 - DNA, 555 bp, Homo sapiens
  misc_feature: GZ8MTXP02JBZ2W.17.10.A10.1.454.CMB.2.raw
  modified_base (441)..(441): a, c, t, g, unknown or other
  misc_feature (441)..(441): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgttggattcaattatgtgtcctggtaccagcaactcccgggatcacgcccccaaactcctcaactatatgaaagataaataagcgaccctcgacggggttcccctgaccgattctctggctccaagtctggcacgtctgcccacccgtggcatcaccgcgctcccagacgtggggacgaggaccgagttactttcgngcgacgaaacagtggaacttccaagcccttagacttcggtggggtcgttcggactaggtacgggaccaaacggtccacgaaccgtcctagggtccagccccaaggcctacccgg

SEQ ID NO: 339940 - DNA, 527 bp, Homo sapiens
  misc_feature: GZ8MTXP02IUGTH.17.10.A10.1.454.CMB.2.raw
  modified_base (361)..(361): a, c, t, g, unknown or other
  misc_feature (361)..(361): n is a, c, g, or t
  modified_base (468)..(468): a, c, t, g, unknown or other
  misc_feature (468)..(468): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtgggtggggtgggtcagcggctttgacggtaggcacagtatgcacgaagatgaagggcagngtcacgattaccacggacacccccacgaacacagtctacatgacaactgacgagcctgagagctgacgacacggccgtctattactgtcgcgagtaattgttttacngttacattcgtaactaatttgattaggctctaagtcggactcggactttcgtacggggg

SEQ ID NO: 339941 - DNA, 527 bp, Homo sapiens
  misc_feature: GZ8MTXP02HY3I9.17.10.A10.1.454.CMB.2.raw
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
  modified_base (503)..(503): a, c, t, g, unknown or other
  misc_feature (503)..(503): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacacaaaatatggtatgaattgggtgcgacaggcccccggacaagggcttgaggtggggtggggtgggtcgaggcggcgtttgacggtaaggcacagtatgccaccgaagatgaagggcagngtcacgattaccacggacacccccacgaaacacagtctacatgacaacngaacgaacgcctagagagtcagacgacacggccgtntacgtactcgtgcgagaattgtttctgtcatcgtactaattgataggctntagtgactcgacgtttcgacgggg

SEQ ID NO: 339942 - DNA, 627 bp, Homo sapiens
  misc_feature: GZ8MTXP02HZ0MX.17.10.A10.1.454.CMB.2.raw
  modified_base (377)..(377): a, c, t, g, unknown or other
  misc_feature (377)..(377): n is a, c, g, or t
  modified_base (515)..(515): a, c, t, g, unknown or other
  misc_feature (515)..(515): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggttggggtggggtggggtcgaggcgggtcgtttggacggttaaggcacgagtatgccaccgaagatggaagggcagngtcaacgattacccaacggaccacccccagaacacagtctacatgacaaactgaacgagcctgagagcgtagaaccgaccgacgggcccgtacttattaccttggtagaccggtaaagtaaacgtttggtttttaccnggttacctaagttaccggttaaaccttaaacgtttttacggaagttttaacggggcctttaccgttaaagtcggggttaaccttcggggttaaccgtttcggtaccgggggg

SEQ ID NO: 339943 - DNA, 554 bp, Homo sapiens
  misc_feature: GZ8MTXP02H7IZZ.17.10.A10.1.454.CMB.2.raw
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcacaaaatatggtatgaatgggtgcgacaggcccccgganaaggggcttgaggtgggnggggtgggtcagcggctttgacggtaaggcacagtatgccacgaagatgaaggcagngtcacgattaccacgacacccccagaaacacagtcacatgacaacagacgacgaccngagagcgagacgacgacgaccgtacgtactactagtgacgagtaagttagtttcgttcgtactactacgtaacgtaactttacgttagtacgtaacgtacgtacgtacggtacgtacggtacgttacggtcggg

SEQ ID NO: 339944 - DNA, 539 bp, Homo sapiens
  misc_feature: GZ8MTXP02HAN4O.17.10.A10.1.454.CMB.2.raw
  modified_base (371)..(371): a, c, t, g, unknown or other
  misc_feature (371)..(371): n is a, c, g, or t
  modified_base (461)..(461): a, c, t, g, unknown or other
  misc_feature (461)..(461): n is a, c, g, or t
  modified_base (480)..(480): a, c, t, g, unknown or other
  misc_feature (480)..(480): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgaggtggggtggggtgggtcaggcggctttggacggtaaggcacgagtatgccaccgaagataggaagggcagngtcacgattaccacggacacccccgacgaacacagtctacgatgacaactgacgagcctagagagctagacgacacggccgtctattacngtgacgagtaatgttttcngtctactacgtactagttgtagtacgtctacgtagtcgtacgtcggtacgttcggcggg

SEQ ID NO: 339945 - DNA, 508 bp, Homo sapiens
  misc_feature: GZ8MTXP02GEZEM.17.10.A10.1.454.CMB.2.raw
  modified_base (423)..(423): a, c, t, g, unknown or other
  misc_feature (423)..(423): n is a, c, g, or t
  modified_base (462)..(462): a, c, t, g, unknown or other
  misc_feature (462)..(462): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggccccggacaggaggtcaccatctcttgctctcggaacccccatgtgattcaattatgtgtcctggtaccagcaactccggatcacgcccccaaactcctcatatatgaagataataagcgacctcgaggggttcccctgaccgattctctgctccaagtctggcacgtctgcccacccgtgggcatcaccgcgctcccagacgtggggacgaggccgagtactttcngcgacaacagtgggattccagtcctgacttcgtggggtnttcggctaggtcggaccagctgaaccgtcaggtcagccaggctccg

SEQ ID NO: 339946 - DNA, 547 bp, Homo sapiens
  misc_feature: GZ8MTXP02JVIUN.17.10.A10.1.454.CMB.2.raw
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccgganaagggcttgaggtgggtggggtgggtcgagcgggctttgacggtaaggcacgagtagtgccaccgaagagtgaaggggcaagngtcgaacgattaccacggaccacccccaagaaccactagtctaacatgacaactgacgagcctagacgagactggacgacgacgggcctactaattacgtgtcgcgaagtaattgttttctggtacacttcgtaactaatttgaatggctgtatcggactggactttcggcgggg

SEQ ID NO: 339947 - DNA, 533 bp, Homo sapiens
  misc_feature: GZ8MTXP02G7ZND.17.10.A10.1.454.CMB.2.raw
  modified_base (380)..(380): a, c, t, g, unknown or other
  misc_feature (380)..(380): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacacaaaatatggtatgaattgggtgcgacacggcccccggacgaagggcttgaggtggggtggggtggggtcgaggcggtcgtttggacggtaaggcacgagtatgacgaccgaagagtaggaagggcagngtcacgattaccgacggacacccccacgaacacagtctacatgacaactgacgagcctagagagctgacgacacgggccgtactattactgtgcgagattgtttctgtcatcgtatattgatagctgtagtcggactcggacttcgtacgggg

SEQ ID NO: 339948 - DNA, 611 bp, Homo sapiens
  misc_feature: GZ8MTXP02JF8YO.17.10.A10.1.454.CMB.2.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (415)..(415): a, c, t, g, unknown or other
  misc_feature (415)..(415): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctctgctctcgaaacccccatgtgatcatngtntcngtacagcactccggancacgccccaaactccncatatatagaagataataacgcgaccctgacgggttcccctagaccgtattctctcgtctccaagtctggcctacgtctcgcccacccgtggcctactccgaccgcgctccgaagacgtcggggacgnggtacccgtagttacgtttcgacgccgaccgaaacgtaggtacgggtaactttcccgaagtccccgttaggaccgttccggttgggggttctttccggggacgtaaagggttccggggaaccgtaaacggtccgtacgggtaaccccgttaccggtagggttacccaacggacccccgtaagggcccttcccccgg

SEQ ID NO: 339949 - DNA, 538 bp, Homo sapiens
  misc_feature: GZ8MTXP02IBUBB.17.10.A10.1.454.CMB.2.raw
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (473)..(473): a, c, t, g, unknown or other
  misc_feature (473)..(473): n is a, c, g, or t
  modified_base (490)..(490): a, c, t, g, unknown or other
  misc_feature (490)..(490): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtgggtggggtgggtcagcgggctttggacggtaaggcacgagtatgccaccgaagntgaaaggggcaggagtcaacgattaacccgacggaccacccccaacgaaacacaagtctacatcgacaaactgaacgagcctagagacgctagacgacacgggaccgtctaattacngtgcgagaattgtttcngtcatcgtactatttgataggctctagtcgactcgtactttcgcgggg

SEQ ID NO: 339950 - DNA, 614 bp, Homo sapiens
  misc_feature: GZ8MTXP02IXS3Y.17.10.A10.1.454.CMB.2.raw
  modified_base (290)..(290): a, c, t, g, unknown or other
  misc_feature (290)..(290): n is a, c, g, or t
  modified_base (375)..(375): a, c, t, g, unknown or other
  misc_feature (375)..(375): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgganaagggcttggaggttggggtggggtgggtcgaggcggtctttggacggtaaggcacagtatgaccaccgaagagtggaaggcagngtcacgtactaccgacggaccaacccccgagaacacagtacacatgacaacgtcgacgagccgtagagacgcgtagaaccgacgaccgggtcccgtacgttaagtttaccgtggtacggtacgtaaggttaactttcgggtttttacctggttacctacgttaccgttaaacttaacgtttaggattacgggtctttacgtagttacggtacgttacggtacgtttcgggtaccggggg

SEQ ID NO: 339951 - DNA, 557 bp, Homo sapiens
  misc_feature: GZ8MTXP02H2K2Y.17.10.A10.1.454.CMB.2.raw
  modified_base (290)..(290): a, c, t, g, unknown or other
  misc_feature (290)..(290): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (462)..(462): a, c, t, g, unknown or other
  misc_feature (462)..(462): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggccccccgganaagggcttgaggtgggtggggtgggtcaggcggctttgacggtaaggcacgagtatgccaccgaagntagaaggcagngtcacgactaccacggaccaacccccacgaaacacagtctacatgacaactgacgagcctagagagctagacgacgtacgggcctacattacgngtcgacgagtaattcgttttcaggttcacgttccgtaactaaacgttttgaattaggtctacgtaagttcggaattcggtactttccggggcggg

SEQ ID NO: 339952 - DNA, 537 bp, Homo sapiens
  misc_feature: GZ8MTXP02FWSZ4.17.10.A10.1.454.CMB.2.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (460)..(460): a, c, t, g, unknown or other
  misc_feature (460)..(460): n is a, c, g, or t
  modified_base (480)..(480): a, c, t, g, unknown or other
  misc_feature (480)..(480): n is a, c, g, or t
  modified_base (513)..(513): a, c, t, g, unknown or other
  misc_feature (513)..(513): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgganaagggcttgaggtggggtggggtggtcaggcggctttggacggtaaggcacagtatgccaccgaagatggaaggcagngtcacgatacccacggaccacccccagaaacacagtctaacatgacaacctgaacgagcctgagagctagacgacacgggcctactattacngtgacgagtaattgtttacngtactagttacgtaactagtttagattaggctntagtcggactggactttgacgggg

SEQ ID NO: 339953 - DNA, 514 bp, Homo sapiens
  misc_feature: GZ8MTXP02ISNQD.17.10.A10.1.454.CMB.2.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (414)..(414): a, c, t, g, unknown or other
  misc_feature (414)..(414): n is a, c, g, or t
  modified_base (467)..(467): a, c, t, g, unknown or other
  misc_feature (467)..(467): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccganaagggcttgagtgggtggggtgggtcagcggctttgacggtaaggcacagtatgccaccgaagatgaagggcagngtcacgattaccacggacaccccagaacacagtctacatgacaactgacgancctgagagctgacgacacgggcccgtctattactgtgcgtagaattgttttcngtcattcgtanatttgataggctntatggtactggacttcgtcgggg

SEQ ID NO: 339954 - DNA, 567 bp, Homo sapiens
  misc_feature: GZ8MTXP02IRTIX.17.10.A10.1.454.CMB.2.raw
  modified_base (306)..(306): a, c, t, g, unknown or other
  misc_feature (306)..(306): n is a, c, g, or t
  modified_base (465)..(465): a, c, t, g, unknown or other
  misc_feature (465)..(465): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggnggggtggtcgagcggctttggacggtaaggcacagtatcgcaaccgagagtgaaggcagagtcacgattaccacggaccaccccacgaacacagtctacgatgacaaccgtgaacgacgcctaggacgagctacgacgacgacggccgtactattacgngtcgacgaagtaattcggttttacacgttcacttacggtaacttaactttcgattaacggtcgtttacaagttcggacttcggtaccgtttcgtaccggggg

SEQ ID NO: 339955 - DNA, 607 bp, Homo sapiens
  misc_feature: GZ8MTXP02INB8T.17.10.A10.1.454.CMB.2.raw
  modified_base (454)..(454): a, c, t, g, unknown or other
  misc_feature (454)..(454): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgtacagggtcctgggcccagtctgtgttgacacagccgccctcagtgtctgccggcccccggacaggaggtcaccatctcttgctctcggaaccccccatgttggattcaattatgtgtcctggtaccagcaacgtcccggatccacgacccccaaactccctacaatactatagaaagaataaataagccgaccctacgacggggttcctcgaccgtattcctctcggcctaccagtctggccacgtctcgcccacccgtgggcatccaccgcgcctccgagacgtggggacgacggccgagttacttcgngtcgacaacgagtcgggaacttccgagtccgtagtacgttcggtgggggttcgttccgggcgtacggtacggggaacctaacgtccgtacggtaccccggtccgtacggtaccgaccggaccccgaacggtcccgttacccggtcccccccgg

SEQ ID NO: 339956 - DNA, 528 bp, Homo sapiens
  misc_feature: GZ8MTXP02GJK81.17.10.A10.1.454.CMB.2.raw
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (495)..(495): a, c, t, g, unknown or other
  misc_feature (495)..(495): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgaggcccccgganaagggcttgaggtgggtggggtgggtcgagcggctttggacggtaaggcacgagtatgccacgaagatgaaggcagngtcacgataccacgacaccccagaacacagtcanatgacaactgaacgagcctgagagctagacgacgaccgggcctactattacctgtgcgagtaattcgtttctgtcattcgtactaattgataggngttctagtcggtactggtactttcggtacgggg

SEQ ID NO: 339957 - DNA, 607 bp, Homo sapiens
  misc_feature: GZ8MTXP02IJQWL.17.10.A10.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (430)..(430): a, c, t, g, unknown or other
  misc_feature (430)..(430): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaaatatggtatgaattgggngcgacaggcccccganaaggcttgagtgggtggggtgggtcaggcggctttggacggtaaggcaacgagtatgcaaccgaagatgaagggcagngtcagataccgacggacacccccacgaaactacacgtactaacatagacaaacgtgaaacgngaccctagaacgacgctcggaaacgaccgaacgggccctacttaattaaccgtgtacggaccgtagtaaattgtttttcgagttactaacttacgtaacttaaaagttttcgaagttagggaacctttacgtaagttacgggtaaccgtttacggggtaaccttttcggaccggggg

SEQ ID NO: 339958 - DNA, 552 bp, Homo sapiens
  misc_feature: GZ8MTXP02FP5K5.17.10.A10.1.454.CMB.2.raw
  modified_base (365)..(365): a, c, t, g, unknown or other
  misc_feature (365)..(365): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccggacaagggcttgaggtggggtggggtgggtcaggcggctttgacggtaaggcacagtatgcaccgagatgaagggcagngtcacgattaccacggaccacccccaacgaaccacacgtctacatgacaactgaacgagaccctgaagagctacgacgacgaccggccgtacctagttactgtgcgaagtaattgttttactgttctacttcgtaactaagtttcgaagtaggcttactagtcggactacggtacttcgtacggggg

SEQ ID NO: 339959 - DNA, 521 bp, Homo sapiens
  misc_feature: GZ8MTXP02I1YPW.17.10.A10.1.454.CMB.2.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
  modified_base (491)..(491): a, c, t, g, unknown or other
  misc_feature (491)..(491): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaaatntggtatgaattgggncgacaggcccccggacaagggcttgagtgggtggggtggtcagcggctttgacggtaagcacagtatgcaccgagatgaaggcagngtcacgattaccacggacacccccagaaacacagtctaacatgacaaactgaacgancctgagacgctaggacgactacgggccctatacttacgtgtgcgtaagaattggtttctgtcatcgtataagtttnatagctactatggacttggacttcgtcggg

SEQ ID NO: 339960 - DNA, 589 bp, Homo sapiens
  misc_feature: GZ8MTXP02GZ0P2.17.10.A10.1.454.CMB.2.raw
  modified_base (436)..(436): a, c, t, g, unknown or other
  misc_feature (436)..(436): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgttggattcaattatgtgtcctggtaccagcaactcccggatcacgcccccaaactcctcatatatagaagataataagcgaccctcgaggggttcccctagaccgattctctggctccaagtctggcacgtctcgccacccgtggcatccaccgcgctccagacgtggggacgaggccgtagttactttcngaccgcaaacgagtgggacttccagtccctgacctttcggtgggggttcgttcgggcgtaggttcggggaacccaaaggtccgttacggaaccccggttccgtaacgggggttaccaacggtacccccgtaaaagggggccctttcccccggg

SEQ ID NO: 339961 - DNA, 527 bp, Homo sapiens
  misc_feature: GZ8MTXP02JUD22.17.10.A10.1.454.CMB.2.raw
  modified_base (369)..(369): a, c, t, g, unknown or other
  misc_feature (369)..(369): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggtggggtgggtcgaggcggtctttggacggtaaggcacagtatgccaccgaagatgaagggcagngtcacgattaccacggacacccccagaaacacagtctacatgacaactgacgagcctgagagcgtgacgacaccgggccgtctattactgtgcgagtaatgttttcngttcatcgtaactatttgataggctctagtggactggtacttcgtacgggg

SEQ ID NO: 339962 - DNA, 577 bp, Homo sapiens
  misc_feature: GZ8MTXP02H3VH1.17.10.A10.1.454.CMB.2.raw
  modified_base (384)..(384): a, c, t, g, unknown or other
  misc_feature (384)..(384): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacaggcccccggacaagggcttgaggtggggtggggtggggtcgaggcggtctttgggacggttaaggcaacgaggtatgaccgaccgaagagtaggaaaggggcaagnggtacacgaacttacccgaccgggaccaacccccgaacgaaaccacacgtactaacatagacaactgacgagccgtgagacgctaggacgacacgggccgtctacgttactgtgacgagtattgtttctgtcctatccgtaattacgtttgataggtctcgttagtcggtacgtcggtacgtttcgacggggg

SEQ ID NO: 339963 - DNA, 599 bp, Homo sapiens
  misc_feature: GZ8MTXP02IEHZV.17.10.A10.1.454.CMB.2.raw
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (363)..(363): a, c, t, g, unknown or other
  misc_feature (363)..(363): n is a, c, g, or t
  modified_base (419)..(419): a, c, t, g, unknown or other
  misc_feature (419)..(419): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttnacaaaatntggtatgaatgggtgcgacgacggcccccgganaagggctgagggtgggtggggtggtcgagcggtctttggacggtagcacgagtatgccacgaagagtgaaggcagngtacacgacttaccgaccggaccaaccccacgaacacagtactacatgctaaacgngacgacgcgagagacgtcgacgaccgacgaccggtccgttacttaacgttacgtggtacgaggtaagttacgtttcgtttacgtgttactacgtttacgttaaacgttagtttacgtacgttacgttaacgttacgttaggtacggtacggtttacggttaccggtttacgggtacgggg

SEQ ID NO: 339964 - DNA, 663 bp, Homo sapiens
  misc_feature: GZ8MTXP02H2MCI.17.10.A10.1.454.CMB.2.raw
  modified_base (478)..(478): a, c, t, g, unknown or other
  misc_feature (478)..(478): n is a, c, g, or t
  modified_base (609)..(609): a, c, t, g, unknown or other
  misc_feature (609)..(609): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctcctgacaaggccagtggattatatcttacaacaaaatagtggtataggtaagttgggagcgacgaccggacccccggaagtaacgggtgttggagggttggggtaggggtgggtacgagggtcgggtcgtttagggaacgggttaaggcaaacgtagtacgagacccgaaccggaagtagagggaaggcaaggcgtacgaacgacgttaacccgaaccgaccccaaacccctaagaaccacgacgttacacgancgacaagcgacgacgtcagacgacgcgacggacgacgaccggtaccgttataccgtagttcggacgtacggtaagtttaacgttcggtttttcaacggtttcaaacgtttaccgtaaacttaaacggtttnaacgttacgtccgttacgtaagtcggtacgttcggtacgtttcggaaccggggg

SEQ ID NO: 339965 - DNA, 590 bp, Homo sapiens
  misc_feature: GZ8MTXP02ILHTA.17.10.A10.1.454.CMB.2.raw
  modified_base (381)..(381): a, c, t, g, unknown or other
  misc_feature (381)..(381): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaattgggtgcgacacggcccccggacaagggcttggaggtggggtggggtgggtcgaggcggtcgtttggacgggtaaggcacgagtatgccaaccgaagagtaggaagggcagngtcacgacttaccgacgacacccccacgaacacgacgtactacatacgacaacgtcgaacgaacgcctagagagcgtacgacgacgaccgggccgtacgtaacttacgtgtcgacgtagtaagttcgttttcgtgttactacttcgttaactaacgtttagattacggcttacgtacgttcggtactcggtacgtttacggtccggggg

SEQ ID NO: 339966 - DNA, 702 bp, Homo sapiens
  misc_feature: GZ8MTXP02I7FFQ.17.10.A10.1.454.CMB.2.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcgaggcggcgtttggacgggtaaggcacgagtagtgaccaccgaagagtaggaaaggggcaaggagtcgaacgtaacgttaaccccgaaacgggaacccaaacccccccgaacggaaaacccaaccgaaacggttaccctaaacaacttacggaccaaacgtacggaacgacgtacccgagaaacggagaccgtacggaacgacccgaaccggggccccttacgttaacgttaaccgttggtaggaccggtaaagtaaagtttcggtttttacgtcggtttactaaacgttaccggttaaacctaaacgtttttcggaaagttagggtaaccttacgttaaggtacggggtaacctttagggtaacccgtttcggttaaccgggggg

SEQ ID NO: 339967 - DNA, 540 bp, Homo sapiens
  misc_feature: GZ8MTXP02F3MC3.17.10.A10.1.454.CMB.2.raw
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggtggggtgggtcgaggcggtctttggacggtaaggcacgagtatgccaccgaagatgaagggcagngtcacgattaccacggacacccccagaacacagtctacatgacaactgaacgagcctagagacgctcggacgacacgggccgtactagttactgtcgcgagtaattgtttactgtctattcgtactaatttcgattaggctactagtcggactcggtacttcgtacgggg

SEQ ID NO: 339968 - DNA, 545 bp, Homo sapiens
  misc_feature: GZ8MTXP02IT7YS.17.10.A10.1.454.CMB.2.raw
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcacaaaatntggtatgaattgggtgcgacacggcccccgganaacggggcttggaggtggggtggggtggtcagcggctttgacggtagcacagtatgccaccgagatgaaggcagngtcacgataccacggacacccccagaacacagtcacatcgacaactgacgagcctggagagctagaccgacacgggaccgtctattactggtacgcgtaagtattggttttcaggttcagttaccgtaactaagtttcgaacttaggtctcttaagtcggtaactggtactttcggtcggggg

SEQ ID NO: 339969 - DNA, 577 bp, Homo sapiens
  misc_feature: GZ8MTXP02JAZ6T.17.10.A10.1.454.CMB.2.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctctgctctcgaacccccatgtgatcatngtntctgtacngcacgtccggatcacgccccaaactcctacatatatagaagataataacgccgacccctcgacgggttcccctagaccgtattcctctcggcctccgaagtctggccacgtctcgcccacccgtggcactcaccgcnctccgagcgtggggacgnggaccgagttactttcgngaccgtacgaaaccgtaggtcgggtacttacccgagtcccgtaggtccgtttcggtgggggttcgtttccgggcgtaggtcggggaaccacggtccgtacggaacccgttcgtaaggtccacggacccgaaggccgttcccccgg

SEQ ID NO: 339970 - DNA, 531 bp, Homo sapiens
  misc_feature: GZ8MTXP02FG1SN.17.10.A10.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (474)..(474): a, c, t, g, unknown or other
  misc_feature (474)..(474): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatatggtatgaattgggtgcgacaggcccccgganaagggcttgagtgggtggggtgggtcagcggctttgacggtaaggcacagtatgccaccgaagatgaagggcagngtcacgattaccacggacacccccagaaacacagtctaacatgcaactgaacgagcctgagagctgacgacaacgggccgtactattacgagtgcgagtaaactgttttcngtctactcgtaacaatttgaattaggctactagtaggtactggacttcgtacggggg

SEQ ID NO: 339971 - DNA, 553 bp, Homo sapiens
  misc_feature: GZ8MTXP02JZ9MN.17.10.A10.1.454.CMB.2.raw
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaacccccccaatcgttggattcaattatgtgtcctggtaccagcaacgtccggatcacgcccccaaactcctcatatatgaagataataagcgacctcgtaggggtcccctgaccgtattctcgtggctccaagtctggctacgtctcgcccacccgtggcactcaccgcgctccgagcgtgggacgaggccgtagtatttcgngcgcaacgngtcgggtactcgacgctagacttccggtggggtcgttcggcgtacggtcgggaccaacggcctacggaacccgttcgtaacggtcacgtcccgaaggtcctccccgg

SEQ ID NO: 339972 - DNA, 678 bp, Homo sapiens
  misc_feature: GZ8MTXP02G6V54.17.10.A10.1.454.CMB.2.raw
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggngcgacacggcccccgganaagggcttggaggttggggtggggtgggtcaggcggtcgtttggacgggtaaggcgacgagtagtgacccgaccggaagagtagggaagggcaaggacgtccgaacggtacttaacccgaccgggaacccaaccccccgaagaaacccacacgtacctacatcgacaacgtcgacgagcctagacgacgcgtaggaccgaccgaccgggtaccgttaccgttaacgtttaccgtgggttacggaccgggttaaagttaaagtttcggtttttacgtacgtttaccgtaacgtttacggttaaacctttaagttttacggtaagtttaacggggtctttacgttaaggttcgggtaccgtttaggggtaccgtttcggggtaccggggg

SEQ ID NO: 339973 - DNA, 622 bp, Homo sapiens
  misc_feature: GZ8MTXP02HBB5H.17.10.A10.1.454.CMB.2.raw
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtgcgacaggcccccggacaaggcttgaggtgggtggggtgggtcgaggcggctttggacggtaaggcacgagtatgccaccgaagatggaaggcagngtcacgataccacggacacccccaagaaccacacgtactaacatacgacaacgtacgaacgacgacccgtggaacgacgaccgtaggaaccgaaccgacggggacccttactaacttacgtgtcggacgtaagtaacgtttgttttaccgtggttacctaagttaccggttaactaaacgttttacgaacgtttaaggtcctttacgttaaggtcgggttaacgttcgggtaaccgttttacggtaccggggg

SEQ ID NO: 339974 - DNA, 521 bp, Homo sapiens
  misc_feature: GZ8MTXP02FW5RV.17.10.A10.1.454.CMB.2.raw
  modified_base (288)..(288): a, c, t, g, unknown or other
  misc_feature (288)..(288): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacatgtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtggggtggggtggtcaggcggctttggacggtaaggcacagtatgacaccgaagatgaagggcagagtcacgattaccacggaccacccccaagaacacagtctacatgacaactgacgagcctagagagctagacgacgacggcccgtatattactgtgacgagtaattgtttcngtcatcgtactaatttnataaggctctatggtactggactttcgg

SEQ ID NO: 339975 - DNA, 647 bp, Homo sapiens
  misc_feature: GZ8MTXP02I3BRI.17.10.A10.1.454.CMB.2.raw
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntggtatgaattgggtgcgacaggcccccgganaagggcttgaggtggggtggggtgggtcaggcggtcgtttgacggtaagacacgagtatgaccaccgaagagtaggaaggggcaaggtagtccaacgtaacgttacccgaaccgggaaccaaccccccgacgaaacccacaacggttccaaacgatcgacaacgtagaacgagcccgtgaacgagactaggaccgaccgacgggtacccgttactaatttacgtggtacgcggtaagtaacgttcgtttttaccgaggttacctaagttaccggttaacttaaagttttacgaagttacgggccctttaacgttagttacggggaacctttcggggtaaccttttacgggtcgggggg

SEQ ID NO: 339976 - DNA, 555 bp, Homo sapiens
  misc_feature: GZ8MTXP02HC7VM.17.10.A10.1.454.CMB.2.raw
  modified_base (371)..(371): a, c, t, g, unknown or other
  misc_feature (371)..(371): n is a, c, g, or t
  modified_base (485)..(485): a, c, t, g, unknown or other
  misc_feature (485)..(485): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggacaagggcttgaggtggggtggggtgggtcaggcggctttggacggtaaggcacgagtatgaccaccgaagatggaagggcagngtcacgattaccgacggacacccccaagaacacagtctaacatgacaactgaacgagcctgagagctgacgacgaccgggccgtactattactgtgacgagtaatcgttttacngtcacgttacgtaactagtttacgattaggcttacgtagtcggtacgttcggtactttcggtaccggggg

SEQ ID NO: 339977 - DNA, 686 bp, Homo sapiens
  misc_feature: GZ8MTXP02J0UQV.17.10.A10.1.454.CMB.2.raw
  modified_base (277)..(277): a, c, t, g, unknown or other
  misc_feature (277)..(277): n is a, c, g, or t
  modified_base (396)..(396): a, c, t, g, unknown or other
  misc_feature (396)..(396): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgtaattgggtncggacgacggcccccggagaagggtcttggaggtggggtggggtgggtcgaggcgggtcgtttaggacgggtaaggcaacgtagtagtgacccgaaccggaagagtaggaagggcaagnggtaccaacgtactacccgacggaacccacccccgagaaaccaccagtacctaacatcgaccaacgtcggaacgacgaccgtagaacggacgcctacggaccgaaccgaccggggtcccttacgtacgtttaacgtcgggtacgacggtaagttaacgtttcgttttcgttacggttactaacgtttaccggttaaacttaaagttttacgtaacgtttaacgggtcctttaaccgttaggttacgggttaccgttacgggttaacccggtttcgggttaacccgggggg

SEQ ID NO: 339978 - DNA, 551 bp, Homo sapiens
  misc_feature: GZ8MTXP02JAJRG.17.10.A10.1.454.CMB.2.raw
  modified_base (288)..(288): a, c, t, g, unknown or other
  misc_feature (288)..(288): n is a, c, g, or t
  modified_base (365)..(365): a, c, t, g, unknown or other
  misc_feature (365)..(365): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtgggtcaggcggctttggacggtaaggcacgagtatgccaccgagatggaaggcagngtcacgattaccgacggacacccccagaaacacagtactacatgacaactgacgagcctagagagctagacgacgacgggccgtactattactgtcgacgagaagttgtttactgtactagttacgtaactagttttacgattaggtccttacgtaattcggaacgttcggacgtttcgtcggggg

SEQ ID NO: 339979 - DNA, 557 bp, Homo sapiens
  misc_feature: GZ8MTXP02HG7BY.17.10.A10.1.454.CMB.2.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (462)..(462): a, c, t, g, unknown or other
  misc_feature (462)..(462): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcngcaagccagtgatatntctnanaaatatggtatgaatgggtgcgacacggccccganaggcttggaggtgggtgggtggtcgaggcggtctttggacggtaggcacgagtatgaccgacgaagagtaggaagggcaaggcgtacgacgtacttacccgaccggacccacccccacgaaaccacgacgtacacgatgacaactgacgagcctagacgagctagacgacacggccgtntacgtacgtgtgacgagtaattgtttactgtctacgttacgtaactagttgacgtagtctacgtagtacgtacgttcgtacgttcggtaccgggg

SEQ ID NO: 339980 - DNA, 547 bp, Homo sapiens
  misc_feature: GZ8MTXP02JLYBM.17.10.A10.1.454.CMB.2.raw
  modified_base (288)..(288): a, c, t, g, unknown or other
  misc_feature (288)..(288): n is a, c, g, or t
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtggggtggggtgggtcgaggcggcgtttggacggtaaggcacgagtatgccacgaagatggaagggcagngtcacgattaccgacggaccacccccagaaccacagtctacatcgacaactgacgagcctagaagagctaggaccgacgacgggaccgtactagttacgtgtgcgagtaacttgtttctgtactatcgtaactatttcgataggtctatagtcggtactcggtacttcggtacgggg

SEQ ID NO: 339981 - DNA, 570 bp, Homo sapiens
  misc_feature: GZ8MTXP02IJJ2A.17.10.A10.1.454.CMB.2.raw
  modified_base (290)..(290): a, c, t, g, unknown or other
  misc_feature (290)..(290): n is a, c, g, or t
  modified_base (381)..(381): a, c, t, g, unknown or other
  misc_feature (381)..(381): n is a, c, g, or t
  modified_base (496)..(496): a, c, t, g, unknown or other
  misc_feature (496)..(496): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcacaaaatatggtatgaaattgggtgcgacaggcccccgganaagggcttgaggtggggtggggtgggtcgaggcggtcgtttaggacgggtaaggcaacgagtatgccaaccgaaagagtaggaagggcagngtacacgattaccacggaccaacccccacgaaacacagtctacatgacaactgaacgagcctgagagctagacgacgaccggccgtactagttactgtgcgagtaattgttttcngttcattcgtaactaagttttcgagttaggctttacgtaagttcgggtaacttcggtaacgtttcggacggggg

SEQ ID NO: 339982 - DNA, 542 bp, Homo sapiens
  misc_feature: GZ8MTXP02IVSMN.17.10.A10.1.454.CMB.2.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (462)..(462): a, c, t, g, unknown or other
  misc_feature (462)..(462): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcacaaaatatggtatgaattgggtgcgacaggcccccgganaagggctgaggtggggtggggtgggtcaggcggcgtttgacggtaggcacagtatgcacgaagatgaagggcagngtcacgattaccacggacacccccacgaaacacagtctaacatgacaactggacgagcctagagaagctacgacgaccacgggacccgtactagttaccngtacgcgaagtaattggttttctggtactattccggtaactatttgataggtctcgtatggacttggactttcgtcgggg

SEQ ID NO: 339983 - DNA, 631 bp, Homo sapiens
  misc_feature: GZ8MTXP02ICRDF.17.10.A10.1.454.CMB.2.raw
  modified_base (375)..(375): a, c, t, g, unknown or other
  misc_feature (375)..(375): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatgtatgaattgggtgcgacgacggcccccggacaagggcttgaggtgggtggggtgggtcgagcgggtctttggacgggtaaggcacgagtatgccaccgaagagtaggaagggcagngtcacgacttaaccgacggaccacccccacgaaaccacagtactacatgacaacgtgaacgacgccgtagacggagaccgcggaaccgaccgaccgggaccccgttacgtaacgtttaacgtcgttacggacggaagttaaagtttacgtttttaccgtggttactaacgtttaccggttaaacttaagtttacgtagttaacggtcttaccgttagttacgggtacgttacggggtacttttacgggtccggggg

SEQ ID NO: 339984 - DNA, 637 bp, Homo sapiens
  misc_feature: GZ8MTXP02FTRRR.17.10.A10.1.454.CMB.2.raw
  modified_base (257)..(257): a, c, t, g, unknown or other
  misc_feature (257)..(257): n is a, c, g, or t
  modified_base (367)..(367): a, c, t, g, unknown or other
  misc_feature (367)..(367): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcacaaaatntggtatgaattgggtgcgacaggcccccggacaagggcttgagtgggtggggtgggtcaggcggctttggacggtaaggcacgagtatgccaccgaagatgaagggcagngtcacgataccacggacacccccagaaacacagtctaacatgacaactgaacgagacctagaagacgctacggaacgaccgtaaccgggaccgttaccttaacttaacgtggttacggccgaaagtaaaacgtttggtttttaccgtggttacctaagttacccgttaaacttaaacgtttttacggaactttaagggggtaacctttaccgttaaagttacgggggtaacctttacggggtaaccgttttccgggttaacccggggggg

SEQ ID NO: 339985 - DNA, 565 bp, Homo sapiens
  misc_feature: GZ8MTXP02I7CX8.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaaattgggtgcgacacggcccccggacgaagggcttggaggtggggtggggtgggtcgaggcggctttggacggtaaggcacagtatgccacgaagatgaagggcagagtcaacgacttaaccacggacacccccaacgaaacacagtctaacatgacaactgacgagcctgaagagctagacgacgacggaccgtactattacctggtcgacgtaaggtaattcggttttctaggttctacgttacgtaactaatttacggattaggcttacgtagtcggactggtaacgttcgtacgggg

SEQ ID NO: 339986 - DNA, 585 bp, Homo sapiens
  misc_feature: GZ8MTXP02GKMZ6.17.10.A10.1.454.CMB.2.raw
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggtggggtgggtcaggcggctttggacggtaaggcacgagtatgccaccgaagatgaagggcagngtcagattaccacggacacccccacgaaacacagtctacatgacaactgacgagcctagagagctgacgacacgggccgtactaattactgtcgcgtaagtaaattcggtttttactcgttctacttacggttaaactaaacgttttcggaatttaacggggctttaccgttaaagttcgggaaccgtttagggtaaccgttttaccggtcgggggg

SEQ ID NO: 339987 - DNA, 625 bp, Homo sapiens
  misc_feature: GZ8MTXP02HT4Z0.17.10.A10.1.454.CMB.2.raw
  modified_base (372)..(372): a, c, t, g, unknown or other
  misc_feature (372)..(372): n is a, c, g, or t
  modified_base (443)..(443): a, c, t, g, unknown or other
  misc_feature (443)..(443): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacacggcccccggagaagggcttgaggtggggtggggtggtcaggcggcgtttggacggtaggcacgagtatgaccacgagatggaagggcaggngtcacgattacccgacggaccaccccacgaacacacgtctaacgatcgacaaccgtgacgacgcctagagngacctggaaccgaccgaaccgggtcccgttctaaacgttaccgtggtacggtaccgtaagtaatttcggtttttctacggtttcaacgtttaccggttaaacttaaagtttccgtaagttagggtaacctttacgtaagtttacgggaacgtttcgggtaaccgttttcggtaaccgggggg

SEQ ID NO: 339988 - DNA, 588 bp, Homo sapiens
  misc_feature: GZ8MTXP02HISUQ.17.10.A10.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (366)..(366): a, c, t, g, unknown or other
  misc_feature (366)..(366): n is a, c, g, or t
  modified_base (423)..(423): a, c, t, g, unknown or other
  misc_feature (423)..(423): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggcccccgganaagggcttgaggtgggtggggtggtcaggcggctttggacggtaaggcacagtatgccaccgaagataggaaggcagngtcagattaccacggaccaccccagaacacagtacacatgacaactgaacgagaccngaagacgcgtaggacgacgtaacggccgtactaagttacctggtagaccgaagtaagtttcgtttttacgtacgttactacgttacgttaacttaacgtttacgtaacgttacggtaacttacgttacggttacggtacgttacggttacggtttcggtacgggg

SEQ ID NO: 339989 - DNA, 617 bp, Homo sapiens
  misc_feature: GZ8MTXP02HYCFA.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctacggaaaccccccaatgttggattctaattatgtgtcctggtaccagcaactcccggatcacgcccccaaactcctacatatatagaagataataacgccgtacccctcgtacggggttcccctagacccgtattcctcgtcggcctccgaagttctggcctacgtctcgccctacccgtggccatccaccgcgctaccgagacgtacggggacgacggaccgtagttactttcgtgaccgacaaaccgtagtacggggtaactttcccgaacgtcccgttagtaccgtttcggttcgggggttacgtttcgggactaggggttacgggaacccaaggtcgtacggaacccgttcgtacggtaccacgacccgaacggtccctccccgg

SEQ ID NO: 339990 - DNA, 524 bp, Homo sapiens
  misc_feature: GZ8MTXP02IF39C.17.10.A10.1.454.CMB.2.raw
  modified_base (440)..(440): a, c, t, g, unknown or other
  misc_feature (440)..(440): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaaccccccaatgttggattcaattatgtgtcctggtaccagcaactcccgggatcacgcccccaaactcctcatatatgaagataataagcgaccctcaggggttcccctgaccgattctctggctccaagtctggcacgtctcgccaccctggcatcaccgcgctcccagacgtgggggacaggcccgagtatttcgtgccgcaaacngtgggacttccaaggccctgacttcgtgggggtcttcggctaggtcgggaccaagctgaaccgtctaggcacgcccaagctccg

SEQ ID NO: 339991 - DNA, 578 bp, Homo sapiens
  misc_feature: GZ8MTXP02GRAJO.17.10.A10.1.454.CMB.2.raw
  modified_base (453)..(453): a, c, t, g, unknown or other
  misc_feature (453)..(453): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgtggattcaattatgtgtcctggtaccagcaactcccggatcacgcccccaaactcctcaatatatagaaagaataaataaagccgaaccctcgacggggttcccctagaccgtattctctggctccgaagtctggacctacgtctcgcccacccgtgggccatccgaccgccgctccgagacgtggggaccaggccgagttatttcgngcgacaacgagtgggacttccgaacgtcctagtacgttcggtggggttcggtcggtcgtaggtcggaccgtaacgcgtacgaaccgtccgtacggtaccgacgtacccgaacggtccgtccccgg

SEQ ID NO: 339992 - DNA, 741 bp, Homo sapiens
  misc_feature: GZ8MTXP02JTNW2.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgtaagttgggtgcgacacggcccccggagaagggcttggaggtggggtggggtgggtcgaggcggtcgtttgggacggttaaggcaacgtagtagtggacccaaccggaaagagtaggaaggggacaggacggtacaacggtaacttaacccgaaccgggaacccaacccccccgaaaggaaacccaaccgtaacggtaccctaacacgtacgacaaacgtacggaaccgaacgacccgttaggaaacgacggccgtaacgggaaccgaaccgacccggggtacccgttacgttaaacgtttaaccgttggttacggaccggtaacggttaaaagtttcggttttttaccgtaggtttactaacgtttaacccggttaaactttaaacgttttacggtaagtttaacgggtctttaccgttaaaggttcggggtaaccgtttacggggttaacccgtttcggggttaacccgggggg

SEQ ID NO: 339993 - DNA, 533 bp, Homo sapiens
  misc_feature: GZ8MTXP02IRCNW.17.10.A10.1.454.CMB.2.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (473)..(473): a, c, t, g, unknown or other
  misc_feature (473)..(473): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgganaagggcttgaggtggggtggggtgggtcagcggtctttggacggtaaggcacagtatgccaccgagatggaaggcagngtcacgataccacggacacccccagaacacagtctacatgacactgacgagcctgagagctagacgacgcggaccgtctattacgtgtgcgtagtattgtttacngtcagtaccgtactaatttgattaggctacttagtcggtactaggtacttcggtacgggg

SEQ ID NO: 339994 - DNA, 550 bp, Homo sapiens
  misc_feature: GZ8MTXP02JDOUS.17.10.A10.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcgaggcggcgtttggacgggtaaggcacgagtatgccaccgaagatgaggcagngtcacgataccacggacacccccagaacacagtactacatgacaactgacgagcctgagagctaggacgacgaccgggccgtacgtaacttaccgtggtcgacgaagtaattgttttccgtgtctatacgttactacgtttgatacggtctcgtagtcggagtcggtacgttcgtacgggg

SEQ ID NO: 339995 - DNA, 641 bp, Homo sapiens
  misc_feature: GZ8MTXP02JGZ5T.17.10.A10.1.454.CMB.2.raw
  modified_base (258)..(258): a, c, t, g, unknown or other
  misc_feature (258)..(258): n is a, c, g, or t
  modified_base (387)..(387): a, c, t, g, unknown or other
  misc_feature (387)..(387): n is a, c, g, or t
  modified_base (461)..(461): a, c, t, g, unknown or other
  misc_feature (461)..(461): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggccagtggatatatcttcacaaaatntggtatgtaagttgggtgcgacgacggcccccggagaagggcttggaggttggggtggggtggggtcgaggcggtcgtttggacggtaagggcacgagtagtgacccgaccgaagataggaagggcagngtcaagtactaccgacggaacccaacccccagaaaccacgacgtactacatacgactaacagaacgacgtaccngaaggacgtacgtacggaccgaaccgaccggggtaccgttacttagtttacccggtggtacgaccggtaagtaacgtttcgtttttaccgagttacccgtagttaccggttaacttaaacgtttcgaagttacggtcttacgtagttacggtacttacggttacgttcgggtaccggggg

SEQ ID NO: 339996 - DNA, 562 bp, Homo sapiens
  misc_feature: GZ8MTXP02IMP4O.17.10.A10.1.454.CMB.2.raw
  modified_base (292)..(292): a, c, t, g, unknown or other
  misc_feature (292)..(292): n is a, c, g, or t
  modified_base (383)..(383): a, c, t, g, unknown or other
  misc_feature (383)..(383): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaaatatggtatgaattgggtgcgacacggcccccgganaagggcttggaggtggggtggggtgggtcaggcgggctttggacgggtaaggcaacgagtatgaccaccggaaagataggaaggggcaagngtcacgacttaccgacggaccacccccagaacacagtctacatcgacaactgacgagcctagagacgctagaccgacacgggccctacgtattactgtgacgagtaattgttttactgtacacttacgtaactaagtttcgaatacggcttctagtcggactcggactttcgacggggg

SEQ ID NO: 339997 - DNA, 593 bp, Homo sapiens
  misc_feature: GZ8MTXP02IS85U.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaccccccatgttgattcaattatgtgtcctggtaccagcaactcccggatcacgcccccaaactcctcatatatgaagataataagccgaccctcgacggggttcccctgacccgtattcctctcggcctccgaagtctgggaccaccgtctcgcccacccgtgggccatccaccgcgctccgagacgtggggacaggccgtaggttatttcgtgccgacaaccgagttgggaacttccgagtcccgtagtaccgttcggtgggggttcgttcggcgtaacggttcggggaaccctaaggccgttacggaacccggttccgtaacgggtccaacggtacccccgaagggtccctccccgg

SEQ ID NO: 339998 - DNA, 557 bp, Homo sapiens
  misc_feature: GZ8MTXP02HKMVX.17.10.A10.1.454.CMB.2.raw
  modified_base (255)..(255): a, c, t, g, unknown or other
  misc_feature (255)..(255): n is a, c, g, or t
  modified_base (292)..(292): a, c, t, g, unknown or other
  misc_feature (292)..(292): n is a, c, g, or t
  modified_base (537)..(537): a, c, t, g, unknown or other
  misc_feature (537)..(537): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtgatatatcttcaacaaaatntggtatgtaaattgggtgacgacatcgacccccgganaagggcttggaggtggggtggggtggtcgaggcggtcgtttggacggtaggcacagtatcgcaccgaagagtggaaggggcagacgtcaaggtacttaccacggaccacccccaagaacacagtactacagtcgactaacgtgacgagcctagagagcgtagacgacgaccggcgtactattacgtgtagacgtaagtaattcgtttactggttacaagttccgtaactagtttgataaggtctntagtcgactggtactttcgg

SEQ ID NO: 339999 - DNA, 625 bp, Homo sapiens
  misc_feature: GZ8MTXP02G5CS6.17.10.A10.1.454.CMB.2.raw
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacacaaaatatggtatgaattgggtgcgacacggcccccgganaagggcttgaggtggggtggggtgggtcaggcggngtttggacggtaaggcacgagtatgccacgaagatggaggcagngtcacgataccacggacaccccagaacacagtacacatgacaacgtcgacgacgccgtagagacgcgtacggaaccgacgaccgggtacccggtacttaacgttaccgtggtacggtaccgtaaggtaaagtttcggtttttacgtggttacctacgtttaccggttaaacttaaagttttcgaaacgtttacgggaacctttacgttaagttacgggtaccgtttacggggtacgtttaccgggtaccgggggg

SEQ ID NO: 340000 - DNA, 684 bp, Homo sapiens
  misc_feature: GZ8MTXP02IQW0T.17.10.A10.1.454.CMB.2.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgganaagggcttggaggtggggtggggtgggtcaggcggtcgtttaggacgggttaaggccaacgtaggtaagtcggaccccgaacccggaaaggagtaggaaacggggaccgaaggacggttccaaaccggtaaacttaaccccgaaccggggaaccaaaccccccgaaggaaaccaacacgttaccaactagtcgactaacgtacgacgagacccgtagaacggacgactacggaccgacgaccggggtacccttacttaacgtttacgtggtacgacgtaagttaacgttggtttttacctaggttacctaattaccggttaaacttaaacgtttttgaacttaacggtcttacgttaagtcgggtaacgttcggtaacgtttcggaaccggggg

SEQ ID NO: 340001 - DNA, 602 bp, Homo sapiens
  misc_feature: GZ8MTXP02JYBBU.17.10.A10.1.454.CMB.2.raw
  modified_base (514)..(514): a, c, t, g, unknown or other
  misc_feature (514)..(514): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccggagaagggcttgaggtggggtggggtgggtcgaggcggtcgtttggacggtaaggcacgagtatgccaccgaagataggaaggggcagcgtacacggacttaccgacggaccaacccccgagaaaccacagtcctaacatcgacaactgaacgagcctagagacgcgtagaccgacgaccgggtcctactacttacgtggtgaccgtagtaacgtttgtttttacnggttacctagttaccggtaacttaacgtttagacgttaacgggtccttagtacgttgggacctttggggtacctttcggtaccggggg

SEQ ID NO: 340002 - DNA, 649 bp, Homo sapiens
  misc_feature: GZ8MTXP02G316B.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccatcgttgattcaattatgtgtcctggtaccagacaaccgtcccggatccacgacccccaaactcctacatatatagaaagaataaataacgaccgtaccctcgtacggggttcccctagaccgtattacctctcggcctcctaaagtcgtcggacctaccgttctcgcccctaaccccgtgggaccctaacgcccgaacccgccgtcctaccccgaaggtaccggtacgggggaccgtacgggacccgtaggtttactttccgcggaccgaccaaacgtagtcgggtaacttcccgaaggtcccttagacgtttcgggtagggggttcgttacgggcgtaagggtcgggaacccaaggtctacggaacccgtcgtaacgggtccacggaccccgaaggtcctccccgg

SEQ ID NO: 340003 - DNA, 578 bp, Homo sapiens
  misc_feature: GZ8MTXP02FLW2G.17.10.A10.1.454.CMB.2.raw
  modified_base (289)..(289): a, c, t, g, unknown or other
  misc_feature (289)..(289): n is a, c, g, or t
  modified_base (448)..(448): a, c, t, g, unknown or other
  misc_feature (448)..(448): n is a, c, g, or t
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcataaaatatggtatgaattgggtgcgacacggcccccgganaagggctttggaggtggggtggggtgggtcgaggcggtctttggacggtaaggcacagtagtgccaccgaagagtagaaggggcaggagtcaacggattaaccgacggaccacccccgaacgaaacacagtactaacatgacaacgtgaacgaacgccngaagagctagaccgacacgggccgtactagttactgtcgcgagtaattgttttacngtactacgtacgtaactaagtttagattaaggcttacgttagtacggtagtcggaacgtttcggtaaccggggg

SEQ ID NO: 340004 - DNA, 619 bp, Homo sapiens
  misc_feature: GZ8MTXP02GBBA6.17.10.A10.1.454.CMB.2.raw
  modified_base (289)..(289): a, c, t, g, unknown or other
  misc_feature (289)..(289): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacacggcccccgganaagggcttgaggtggggtggggtgggtcaggcggctttggacggtaaggcacgagtatgcaccgaagatgaagggcagagtcacgattaccacggaaccacccccagaaaccacagtactacatgacaactgaacgagacctgaagagctacggacgaccaccggggtcccgtaccttagttacctggttacgaccggaagtaaagttggtttttcctaggttacctattaccggttaaactaaatttttacggaagtttaaagggtcctttacgttaaagttcggggtaaaaccgtttggggtaaaccgtttttcggtaaccggggggg

SEQ ID NO: 340005 - DNA, 542 bp, Homo sapiens
  misc_feature: GZ8MTXP02HXLDR.17.10.A10.1.454.CMB.2.raw
  modified_base (375)..(375): a, c, t, g, unknown or other
  misc_feature (375)..(375): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacgacggcccccggacgaagggctggaggtggggtggggtgggtcgaggcggtcgtttggacggtaaggcacgagtatgccgaccgaagatgaggcagngtcacgattaccacggaccaccccacgaacacagtactacatgacaactgacgagcctgagagctagacgacgacggccgtctacttacgtgtgacgagtaagttcgtttctgtcactcgtactaagttgataggcttctaagtcgactcggtactttcgtacgggg

SEQ ID NO: 340006 - DNA, 666 bp, Homo sapiens
  misc_feature: GZ8MTXP02ITBS4.17.10.A10.1.454.CMB.2.raw
  modified_base (310)..(310): a, c, t, g, unknown or other
  misc_feature (310)..(310): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaattgggtgcgacacggcccccggagaagggcttgaggtggggnggggtggtcgagcggcgtttggacggtaaggcacgagtagtgccgaaccgaagagtaggaagggcaagagtcgaacgacttacccgaacgggaccaacccccaacgaaaccacacgtactaacatcgacaacgtacgaacgacgaccagagagacgtacggaccgaaccgacgggtacccgttacttaacgtttaccgtggtacggtaccggaagttaaacgttgggtttttacctggttactaacgttaccggttaaacttaaacgtttttacggaaacgttaagggttcccttacgtttaaggttacgggtaaccgtttacgggtaacccggtttttcgggtaacccggggggg

SEQ ID NO: 340007 - DNA, 533 bp, Homo sapiens
  misc_feature: GZ8MTXP02JPXV9.17.10.A10.1.454.CMB.2.raw
  modified_base (367)..(367): a, c, t, g, unknown or other
  misc_feature (367)..(367): n is a, c, g, or t
  modified_base (462)..(462): a, c, t, g, unknown or other
  misc_feature (462)..(462): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggacaagggcttgaggtggggtggggtgggtcgagcggcgtttggacggtaaggcacagtatgccaccgaagatgagggcagngtcacgattaccacggacacccccacgaacacagtctacatgcaactgaacgagccctagagacgctacgacgacaccgggccgtctattactgngcgagtaatgtttctgtcatcgtaactaatttgataggctactatcggaactcggtacttcgtaccggggg

SEQ ID NO: 340008 - DNA, 584 bp, Homo sapiens
  misc_feature: GZ8MTXP02J3CF8.17.10.A10.1.454.CMB.2.raw
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (491)..(491): a, c, t, g, unknown or other
  misc_feature (491)..(491): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaattgggtgcgacgacggcccccggagaagggcttggaggtggggtggggtgggnaggcggtcgtttaggacggtaaggcacgtaggtaatgccaccgaagataggaaggcagngtcgaacgtactaccgacggaccaacccccgagaaaccactacgtctaacatgactaacngacgaagcccgagaagngactggaccgacgtaccgggccttctagtttacgngtgacgtagtaagttgttttactgtactagtaccttaactatttcgaattacggtcttactacgtggaaccgttggtacgttcggtccggggg

SEQ ID NO: 340009 - DNA, 630 bp, Homo sapiens
  misc_feature: GZ8MTXP02GKKNE.17.10.A10.1.454.CMB.2.raw
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgtaattggggtgcgacacggcccccgganaagggcttggaggtggggtggggtgggtcgaggtcggtcgtttggacggtaaggcacgagtatgccaccgaagagtggaagggcagngtcacggacttaaccgacggaccaacccccgaagaaaccacagtacaacatgacaacctgaacgacgccgtagagacgacgtagaacgacacgggacccttacgtacgtttaacgtggtacggaccgtaagtaaagtttcggtttttacacggttactaattaccggtaacttaaagtttcggtaacgtttaggtaacccttcgttaaacggtggtaacccgttagggtaaccgttttcgggtaccggggg

SEQ ID NO: 340010 - DNA, 554 bp, Homo sapiens
  misc_feature: GZ8MTXP02JZ3I9.17.10.A10.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcgaggcgggctttggacggtaaggcacgagtatgccaccgagatgaagggcagngtcacgataccgacggaccacccccagaacacacgtctacatgacaactgacgagcctgagagctgacgacaccgggccgtctattactgtgcgagtaattgttttctgtcacttacgtactaaagttttcgaagttacggcttacgttaagtcgggtaacttcgggtaactttcggtccggggg

SEQ ID NO: 340011 - DNA, 631 bp, Homo sapiens
  misc_feature: GZ8MTXP02HJ2XB.17.10.A10.1.454.CMB.2.raw
  modified_base (293)..(293): a, c, t, g, unknown or other
  misc_feature (293)..(293): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaaatatggtaatgaaattggggtgcgacaggcccccgganaaagggcttggaggtggggtggggtgggtcaggcggtcgtttgaacgggtaaggcaacgagtaagtgccaaccggaagagtaggaaacggggcaagtacgtacaacgtacttaacccgaaccgaacccaaacccccaacgaaacactaacgtacaacactcgacaacgtacgaacgacgcgtagacgacgtacgacgaaccgaccgtaccgggcccgttaacgtaattacgtggtacgacgtaagtaatttcgttttacttacgtactactacgtaacttaacgttacgtaagtacgtaacgtacgtacgtacgtacgtacggtacgttacggtcggg

SEQ ID NO: 340012 - DNA, 649 bp, Homo sapiens
  misc_feature: GZ8MTXP02F23LC.17.10.A10.1.454.CMB.2.raw
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
  modified_base (393)..(393): a, c, t, g, unknown or other
  misc_feature (393)..(393): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatntggtatgaagttgggtgcgacgacggcccccggaanaacgggctttggagggtggggtggggtgggtcgaggcggtcgtttggacgggtaggcacgagtatcgaccgaaccgaagagtaggaaggggcaggngtacaacgtactacccgacggacccaacccccgaagaaacacgacgtactaacatcgacaactggaacgacgaccgtagaacggagtaccgacggaacccgaccgtaccgggtacccgttaccttaagttaccgtgggttacgacggtaaaggttaactttcggttttacaggttactacgttaccgttaattacgtttacgagttacggtcttacgtagtacgggtacttacgggtaccgtttacgggccggggg

SEQ ID NO: 340013 - DNA, 559 bp, Homo sapiens
  misc_feature: GZ8MTXP02H604T.17.10.A10.1.454.CMB.2.raw
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggctgaggtgggtggggngggtcgaggcggctttggacggtaggcacgagtatgccaccgaagataggaagggcaggagtcgaacgacttacccgaaccggacccaacccccacgaaacccacagtacctacatgacaactggaacgagccgtagagagctagacgacacggcccgtntacgtactgtgcgagtaattgtttcngttacactacgtactattacgtagtaggtctacgtagtggtacgtcggtacgtttcgacggggg

SEQ ID NO: 340014 - DNA, 549 bp, Homo sapiens
  misc_feature: GZ8MTXP02I95IF.17.10.A10.1.454.CMB.2.raw
  modified_base (253)..(253): a, c, t, g, unknown or other
  misc_feature (253)..(253): n is a, c, g, or t
  modified_base (456)..(456): a, c, t, g, unknown or other
  misc_feature (456)..(456): n is a, c, g, or t
  modified_base (496)..(496): a, c, t, g, unknown or other
  misc_feature (496)..(496): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcgaacccccatgtgatcatatgtntctgtacagcacgtccggatcacgcccccaaactcctacatatatagaaagataaataacgaccgtaccctacgtacggggttacccctagaccgtattcctctcggcctccgaaagtctcggacctacgtctcgccctacccgtcgggacactccgaccgtcgcctaccgagacgtggggacgcggtaccgagttatttcgngcgacaacagtggacttccgagcctagtcttcgtggggtntcggctagtgggaccaagctacgaaccgtcgtaacgcacgcccgagcgtcccg

SEQ ID NO: 340015 - DNA, 546 bp, Homo sapiens
  misc_feature: GZ8MTXP02J2VC0.17.10.A10.1.454.CMB.2.raw
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
  modified_base (432)..(432): a, c, t, g, unknown or other
  misc_feature (432)..(432): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaaggggcttggaggtggggtggggtgggtcaggcggctttggacggtaaggcacgagtatgccaccgaagataggaaggggcagngtcaacgacttaccgacggaccaacccccacgaaaccacagtcctaacatgactaacngacgaagtccagacgagctagaccgacaccgggcgtactagttacngtgacgagaactgttttcngtcatcgtactattgataggcctatagtcggactggtaccttgacgggg

SEQ ID NO: 340016 - DNA, 536 bp, Homo sapiens
  misc_feature: GZ8MTXP02GNCLG.17.10.A10.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (473)..(473): a, c, t, g, unknown or other
  misc_feature (473)..(473): n is a, c, g, or t
  modified_base (496)..(496): a, c, t, g, unknown or other
  misc_feature (496)..(496): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcanaaaatntggtatgaattgggtgcgacaggcccccgganaagggcttggagtggggtggggtggtcgaggcggtntttaggacggtaaggcacgagtatgccacgaagatagaaggcagngtcacgataccacgacacccccagaacacagtctaacatgacaactgacgagccngaagngctagacgacacgggcctactactactgtgcgagtatcgtttcngtactagtcgtaaactagtttanagttagtctatagtcggtactcggtacgttcggtacgggg

SEQ ID NO: 340017 - DNA, 627 bp, Homo sapiens
  misc_feature: GZ8MTXP02GOMDT.17.10.A10.1.454.CMB.2.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccgganaacgggcttggaggttggggtggggtgggtcgaggtcgggtcgtttggacgggttaaggcgaacgtaggtatggaccgaaccgaagagtggaaggggcaaggacgtacaacgtacttacccgacggaaccaccccccgaacaacacacgtactacatcgacactgacgagcctgacgagcgtagacgaccgacgggaccgtcgttacttacgtgtacgacgtagtaattgttttactcgttctaacgtttaccggtaattaacgttttacgaagttacgggtaacttaccgtaagttacgggaccgtttacgggtaccgtttcggtaacccgggggg

SEQ ID NO: 340018 - DNA, 686 bp, Homo sapiens
  misc_feature: GZ8MTXP02JET45.17.10.A10.1.454.CMB.2.raw
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcagcagtgatatatctacaataaatntaggtatgtaagttgggtgacgacgaccggcccccggaagaagggtcgtttggagggttgggggtggggtgggtacgaggtcgggtacgtttagggaacgggttaaggcacgtagtagtcgaccccgaacgtaagagtagggaaggtacgaaggtcgtaccgaacggtaaccgttaaccccgaaccgggaaccccaaacccccgaagaaacccacgtaacgttactaacgatacgactaacgtacggacgacgccgtagagacgcgtacgaccgaccgacgggtacctacgttatacgtgtcgacgtaagttacgtttcgttttacgacgttacgtaacgtttacgttaactttacggtttagtacgtttacgtcgtttacgttacggtacggtacgttacggtttaaccggtttcggggtaacccggggg

SEQ ID NO: 340019 - DNA, 666 bp, Homo sapiens
  misc_feature: GZ8MTXP02GRAHJ.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaacaaaatataggtatgaagttgggtgcgacgacggacccccggagaagggctggaggtggggtggggtgggtcgaggcggtcgtttaggacgggtaaggcacgagtatcgaccaaccggaagagtaggaagggcaagacgtcaacgtacttaacccgacggaacccaacccccgaagaaaccaacagttacaacatagaccaactcggaacgacgaccgtaggaaacggacgtcgacggaaccgaacgacccggggtccctaacgttaagttaccgttggttacggaccggtaagttaaacgtttggtttttctacggttactaacgttacggttaaacttaacgttttgaacgttacggtaactttaccgtaaggttcggtaacgttacgggtaccgtttcggtaaccggggg

SEQ ID NO: 340020 - DNA, 541 bp, Homo sapiens
  misc_feature: GZ8MTXP02JH0U5.17.10.A10.1.454.CMB.2.raw
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccgganaagggcttgaggtggggtggggtggggtcaggcggcgtttggacgggtaaggcacgagtatgccaccgaagatgaagggcagngtcacgattaccgacggacacccccagaaccacagtctacatgacaactgaacgagcctgagngctagacgacacgggccgtactagttactgtcgacgagtaattgtttctgtctactcgtactaatttgataggtctgtactcggtactcgggtacttcgtacgggg

SEQ ID NO: 340021 - DNA, 527 bp, Homo sapiens
  misc_feature: GZ8MTXP02F0UZU.17.10.A10.1.454.CMB.2.raw
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccgganaagggctgagtgggtggggtggtcagcggctttgacggtaaggcacagtatgccaccgaagatagaaggcagngtcacgataccacggacacccccagaacacagtctacatgacaactgaacgagaccctagagacgctacgacgacacggccgtactatactgtgcgagtaatggtttactgtactatcgtaactaatttagattaggctctatacggactggacttcgtcggggg

SEQ ID NO: 340022 - DNA, 543 bp, Homo sapiens
  misc_feature: GZ8MTXP02IYMI1.17.10.A10.1.454.CMB.2.raw
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccggacaagggcttgaggtgggtggggtgggtcaggcggctttggacggtaaggcacgagtatgccaccgaagataggaaggcagngtcacgattaccacggacacccccgagaaacanagtctacatgacaactgacgagcctgagagctggaccgacgacggccgtctattactgtcgcgtaagaactttgtttctagtctagttcgtaaactatttcggatagcttctagtcggactaggtacgtttcggtcgggg

SEQ ID NO: 340023 - DNA, 666 bp, Homo sapiens
  misc_feature: GZ8MTXP02I60PW.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatgaagttgggtgcgacgacggacccccggagaagggcttggagggttggggtggggtgggtcgaggtcggtcgtttaggacgggtaaggcaacgagtatcgacccaacgaagagtaggaaggacgaagagtacgaacgtacgttaacccgaaccggaacccaaacccccgaacgaaaccaacgacgtacctaacactacgacaacgtacgaacgacgtaccgagacggacgcgtacggaccgaccgaccgggtacccgtacgttacgttaccgtggtacgacgtaagtaagtttcgttttacgtcgttacacgtttaccgttaacttaacgtttagtaacgttaacggtccttacgttaggttacggtaacgttcgggtaaccgtttcgggtaccggggg

SEQ ID NO: 340024 - DNA, 569 bp, Homo sapiens
  misc_feature: GZ8MTXP02HGZ0K.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaaattgggtgcgacacggcccccggagaagggcgttggaggtggggtggggtgggtcgaggcggtctttggacggtaaggcacagtatgccgaccgaagagtggaagggcaggagtcaacgattaccgacggaccacccccacgaaccacagtactacatgacaactgacgaagcctagagagctgaacgacgacggccgtacgtacgttaactgtcgacgaagtaagtcgtttttcaggttcaattccgtaactagtttacgaagttaggcttcgtatggaacgtggtaaccttcgtacggggg

SEQ ID NO: 340025 - DNA, 581 bp, Homo sapiens
  misc_feature: GZ8MTXP02F14KX.17.10.A10.1.454.CMB.2.raw
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccggacaggaggtcaccatctcttgctctcggaaaccccccaatgttggattcaattatgtgtcctggtaccagcacgtcccggatccacgcccccaaactccctcatatactagaagataaataagccgacctcgaggggttcccctagaccgtattctctggctccaagtctgcacgtactcgcaccctcggtcgactacncccgacgtccnccacgacgtcgggacggacggaccggagtaagttcgtgccggacaacacgtgggtactcctacggcctcgtacgttccgttggggttggttacggtccgaggttcgggaccgtaaacgtcgtcgaacccggtccgtaacggtccgcgacccgtaacggccgttccccg

SEQ ID NO: 340026 - DNA, 705 bp, Homo sapiens
  misc_feature: GZ8MTXP02IL60D.17.10.A10.1.454.CMB.2.raw
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
  modified_base (412)..(412): a, c, t, g, unknown or other
  misc_feature (412)..(412): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtccagactggggctgaggtgcagaagccgtggggcatcagtgactgtctcctgcaaggcagtgatatatcttacaactaaaatntggtatgaagttgggtgcgacacggcccccgganaagggctttggaggtggggtggggtggtcaggtcggtntttggacggtaaggcacgagtancgacaacccgaagatggaagggcaagagtcaacgtatacccgacggaccacccccgaanaaccaacacgtacctaacagtacgacctaaacgtggaaacccggaacgcccgtaggaacggacgtaccgttacggaaacccggtaaccgaacccgggtccccgttaaccgttaaacgtttaaccggttgggttacggaccggttaaaaggttaaagttttcgtttttacccgttaggttaccgttaacttaccgttaaacgtttaaagttttacgtaacgttaacggtacgttaaccgttagttagggtaccgttacggggtaccgttttccgggtacggggggtaaccccgg

SEQ ID NO: 340027 - DNA, 597 bp, Homo sapiens
  misc_feature: GZ8MTXP02GUOSM.17.10.A10.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcacaaaatatggtatgaattggggtncgacaggcccccgganaaggggctggaggtgggtggggtggggtcaggcggtcgtttggacggtaaggcacagtatgccaccgagatgaaggcagngtcaacgacttaccgacgacacccccgagaaaccacagtctaacatcgacaacgtgaacgagtcccaggagagtctaggaccgacgtacccgggacccggtacttaacgttaccgtggtacggacgtaaggtaaacttgggttttaacctggttctaacttacggttactaaagtttcgaagttaggtaacttcgtaagttggaccgtggtaacctttcggtacggggg

SEQ ID NO: 340028 - DNA, 625 bp, Homo sapiens
  misc_feature: GZ8MTXP02IRPTN.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacgggtgcccacgcccaggttcagttggtgcagacgtggggctgaggtgcagaagcctggggcatcagtgactgtctcctgcaaggccagtggatatatcttacacaaaatatggtatgaattgggtgcgacacggcccccggagaagggcttggaggtgggggtggggtgggtcgaggcggtctttaggaccggtaaggcacgagtatgacaccgaagatggaaggcaggatcgacgaattaccgaccggacccaccccaacgaaacacacgtacctacatcgacaacgtgaacgacgtccagacgagacctggaaccgacgacccgggtccgtactaaactttccgtaggtcgaacggtaagtaacgtttcgttttctgtacgtagttaccgttaacgtaaatttttcgggaaattcgggacttcgttaaagttcggtaaaccgtggggtaccctttcgggacgggggtaacccggg

SEQ ID NO: 340029 - DNA, 714 bp, Homo sapiens
  misc_feature: GZ8MTXP02HHNJ8.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctccctctcctccttacccttctcattcactgcacagggtcctgggcccagtctgtgttgacacagcccgccctcagtgtctgccggccccggagaggaggtccaccatctctgctcaccgaacccccatgtgatacaattatgtgtcctggtaccagacaaccgtccgggataccgacgaccccctaaactcctacaactatatagaaagaataaataacgccgacctacgacggggttccaccgtaccgtacttctcgtggtacctaccgacgttcgtcggccgtaccgttccgtccgaccccgtaaccccggttcggggacctaccgtacccgaccccggccgtcccgttaacccgacggtaaccgggtacggggggaaacccgacggggtaccccggtaaggtttaacgttttccggacgtacggaccaacgtacggtacgggtaacttccgacgtcccgttagtaccgtttcgggttcgggggttcggtttccgggacgttacggggtacggtaacccgaacggtccgtaccggtacccgttaaccggtacgggtaccgacccggacccgaaacgggtcccgtaccccggttcccccgg

SEQ ID NO: 340030 - DNA, 585 bp, Homo sapiens
  misc_feature: GZ8MTXP02HTU9O.17.10.A10.1.454.CMB.2.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccggacaggaggtcaccatctctgctcncgaacccccatgtgatcatntgtntctgtacagcaacgtccggatcacgacccccaaactcctacatatatagaaagtaataaataacgcgacccctagtacggggttcccctagaccgtattctctcggctccaagtctggcctacgtctcgcccacccgtggccatccgaccgcgcctacccgagtacggtgggggacgacgggcccgtaagttactttcgtgaccgtacaacgtgtacggggacttaccgacgtccctgtaccttcgggtgggtcgttcggctagggtacgggacccaaggccgttacgaacccgttcgtaacggtccaccggtacccgaagggtccctccccgg

SEQ ID NO: 340031 - DNA, 620 bp, Homo sapiens
  misc_feature: GZ8MTXP02ILR3J.17.10.A10.1.454.CMB.2.raw
  modified_base (287)..(287): a, c, t, g, unknown or other
  misc_feature (287)..(287): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggcagtgatatatcttcaacaaaatatgtatgaattgggtgcgacgacggcccccgganaacgggcttggaggtggggtggggtgggtcgaggtcggtcgtttaggacgggttaaggcacgagtagtgaccaaccgaagagtaggaagggtcagcggtacaacgtacttacccgaaccgggaaccacccccgaaacgaaacacaacgtactaacatacgacaaacgtcgaacgagccgtaggaagacgcgtacgaccgacgacgggtcccgtactacgttacgtgtacggacgtacgaagtttcgttttactacgttactacttacggttaacttacgttagtaagtacggtcgttactagtacggaacgtcggttaacgttcggtacgggg

SEQ ID NO: 340032 - DNA, 624 bp, Homo sapiens
  misc_feature: GZ8MTXP02HW9JE.17.10.A10.1.454.CMB.2.raw
  modified_base (293)..(293): a, c, t, g, unknown or other
  misc_feature (293)..(293): n is a, c, g, or t
  modified_base (553)..(553): a, c, t, g, unknown or other
  misc_feature (553)..(553): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctcctgcaaggccagtggatatatcttacaacaaaatatggtatgaattgggtgcgacacggcccccgganaagggcttggagggttggggtggggtggggtcgaggcgggtcgtttggacgggttaaggcgaacgtaggtatgcccgaaccgaaagagtagggaaaggggcaaggacgtacgaacgactttaacccgaacgggaacccaaaccccccgaacgaaaccaccaacgtacctaacatcgacaacgtagaacgacgccctagaagacgcgtacgacgaccgacgggcccgtactattaccgtgtgacgtagtaattgttttacngttctacttcgtaacttaagtttcgaattaggtccttagtagtcggtactcggtacgtttcggaccggggg

SEQ ID NO: 340033 - DNA, 726 bp, Homo sapiens
  misc_feature: GZ8MTXP02IL6KC.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcacaaaatatggtatgaattgggtgacgacacggcccccggagaagggcttggaggtggggtggggtggggtcgaggcgggcgtttggacgggtaaggcaacgagtagtgacccgaaccgaaggagtaggaaacggggcaagggacgttaccgaacggaactttaaaccccgaaccgggaacccaaacccccccgaaacggaaacccaaccaacggtaccctaacacgtacgacctaaacgtacggaaccgacgacccgtaggaacgaggactacgggaaccgaaccgaccgggtcccgttacttaacgtttaacccgtggttacggaccgtaaaggtaaagtttcggtttttacgtggtttaccaaacgtttaccggttaaaccttaaacggtttttaacgtaagttaacgggtccttacggtttaagttacggggtaactttcggggtaaacccgttttccggggtaaccgggggg

SEQ ID NO: 340034 - DNA, 542 bp, Homo sapiens
  misc_feature: GZ8MTXP02IM02N.17.10.A10.1.454.CMB.2.raw
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgaggtgggtggggtggtcagcggctttgacggtagcacngtatgccacgagatgaaggcagngtcacgattaccacggacacccccacgaacacagtctacatgacaacgtgacgagcctagagagctacgacgacacgggcccgtctacttactgtgcgtagtaattcgttttactgttccattacgtaactaacgtttacgattaggcttacgtatggaccttggtactttcggtacggggg

SEQ ID NO: 340035 - DNA, 575 bp, Homo sapiens
  misc_feature: GZ8MTXP02H1YJS.17.10.A10.1.454.CMB.2.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagcgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtggtcagcggctttggacggtaaggcacagtatgcaccgaagatgaagggcagagtcacgataccacggacacccccagaacacagtctacatgacaactgacgagcctagagagctgacgacacggcctntattactgtgcgagattgttttcngtacatcgtataattttgataggtctctagtggaacttggactttcggtaggggacccgagggggtaccacggtgacttccggtctccgagtccaacgtccctaccgaaaccgaacgggcccctaacgttcccggtcccttccccccgtggaaccctaccccgtacctacccgaacgaccgtccaaccgtccggg

SEQ ID NO: 340036 - DNA, 714 bp, Homo sapiens
  misc_feature: GZ8MTXP02H4HBR.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctctgcaaggccagtggatatatcttacaacaaaatatggtatgaagttgggtgcgacgacggcccccggagaagggtctggagggtggggtggggtggggtcgaggcggtcgtttggaacggggttaaggcgaacgtaggtatcggacccgaaccggaaaggtacgtagggaaggggaccgaagggtacggttaccgaacggtaaccgtttaaaccccggaaaccggggaacccccaaacccccccgaaacggaaacccaaccgaacggttacccttaacaactacgaccgtaaaccgtaggaaacccggacgacccgtaaggacggaacgtccgtaggaaccgaaccgaaccgggtccgttactaacttacgtgacgaccggtaagtaactttcgtttttactcggttactacgttaccgttaacgttaacgtttcgtaagtacggtcttacgttaaggtcggtacgtacggtacgtttacggaccggggg

SEQ ID NO: 340037 - DNA, 546 bp, Homo sapiens
  misc_feature: GZ8MTXP02IZV57.17.10.A10.1.454.CMB.2.raw
  modified_base (364)..(364): a, c, t, g, unknown or other
  misc_feature (364)..(364): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtgggtggggtgggtcaggcggctttgacggtaaggcacagtatgcaccgaagatgaagggcagngtcacgattaccacggacaccccacgaaacacagctacatgacaacctgacgagcctagagagctagacgaccacggaccgtactattactgtagcgtaagaattgtttttactggttacacttacggttaactaagtttagattaggaaccttcgtatcggactaggtacttcgtcggggg

SEQ ID NO: 340038 - DNA, 568 bp, Homo sapiens
  misc_feature: GZ8MTXP02FKXB6.17.10.A10.1.454.CMB.2.raw
  modified_base (383)..(383): a, c, t, g, unknown or other
  misc_feature (383)..(383): n is a, c, g, or t
  modified_base (449)..(449): a, c, t, g, unknown or other
  misc_feature (449)..(449): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgttggattcaattatgtgtcctggtaccagcaactcccggatcacgcccccaaactcctcatatatgaaagataaataagccgaccctcgacggggttcccctagaccgattctctggcctccaaagtctggcacgtcncgcccacccgtgggccatccaccgccgctcccgagaccgtggggaccgaggaccgtagtatttcgngtccgacaacgagtcggggacttccgagtcctagtacttcggtgggggttcgttcgggcgtaggtcgggacctaacgcgtacgaaccgtcgtacggtcacgcccgaacggccgtccccg

SEQ ID NO: 340039 - DNA, 653 bp, Homo sapiens
  misc_feature: GZ8MTXP02I7T2L.17.10.A10.1.454.CMB.2.raw
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgaggtggggtggggtgggtcaggcggtcgtttggacggtaaggcacgagtatgccaccgaagagtaggaaggcagngtcacgattaccgacggacacccccganaacacacgtctacatgacaactgacgacgcctagaacgacgctaggaccgaccgaccgggtacccgtcttaacgtttaccgtggttacgaccggtaagtaaaacgtttcggtttttaccgtggtttacctaaacgtttaccggttaaaacctttaaacgttttacggtaaatttacggggtaaccctttacgttaaggttacggggtaaccgtttacggggtaaacccgtttttcgggttaacccggggggg

SEQ ID NO: 340040 - DNA, 518 bp, Homo sapiens
  misc_feature: GZ8MTXP02HDQQQ.17.10.A10.1.454.CMB.2.raw
  modified_base (367)..(367): a, c, t, g, unknown or other
  misc_feature (367)..(367): n is a, c, g, or t
  modified_base (469)..(469): a, c, t, g, unknown or other
  misc_feature (469)..(469): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggtccccggacaagggcttgaggtggggtggggtgggtcgaggcggcgtttggacggtaaggcacagtatgccacgaagatgaaggcagngtcagattaccacgacacccccacgaacacagtctacatgacaactgacgagcctgagagctgacgacgacggcctcgtattactgtgcgagaattgtttcngtcatcgactagttgataggctgagtcggacgtggtacttgtacggggg

SEQ ID NO: 340041 - DNA, 572 bp, Homo sapiens
  misc_feature: GZ8MTXP02IXEDG.17.10.A10.1.454.CMB.2.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntggtatgaattgggngcgacacggcccccgganaagggcttgaggtggggtggggtgggtcaggcggtcgtttggacggtaaggcacgagtatgccaccgaagataggaaggcagngtcacgataccgacggacaccccgacgaacacagtctaacatgacaactgaacgagcctagagagctaggaccgacgacgggcctactattactgtacgacgtaagtaatttcgttttctagtactacgttacgtaaacttagtttacgtaagttacggcttacgtattcggggaacttcggtacgtttcggtacggggg

SEQ ID NO: 340042 - DNA, 666 bp, Homo sapiens
  misc_feature: GZ8MTXP02GC7OR.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaacaaaatatggtatgtaagttgggtgacgacgacggcccccggagaaggcttggaggtggggtggggtgggtcgaggtcggtcgtttgggacgggtaaggcaacgtagtatcggacccgaaccggaagtagtacgggaagggacaggacgtacacggtaaccttacccgaacccgaaccccaaacccccgaacgaaaccaccgtaacgttacctaacagtacgacctaaacgtcgaaccgacggtaccgtagaaggacgacgtacggaaccgaccggtaccgggtacccgttactagttaaccggtgtacggacgtaagttacgtttcgtttcgtacgttactacgttacgttaacttaagtttagagttacggtcttacgtagtcggtacgtacggtacgtttcgggaccggg

SEQ ID NO: 340043 - DNA, 508 bp, Homo sapiens
  misc_feature: GZ8MTXP02GJ60S.17.10.A10.1.454.CMB.2.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatntggtatgaattgggncganaatcgcccccgganaagggcttgagtgggtggggtggtcaggcggctttgacggtaaggcacagtatcgcaccgaagatgaaagggcaggatcacgataccacggacaccccagaacacagtcacatgcaactgacgagtccagagatcagacggactacgggcctctattacngtgcgagattgtttacngtcatcgtataatttgataacgctctatagacgtcgtcgtcg

SEQ ID NO: 340044 - DNA, 686 bp, Homo sapiens
  misc_feature: GZ8MTXP02FOFLS.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttcaacaaaatatgtatgaagttgggtgcgacacggcccccggagaaggtcttggagggtggggtgggggtgggtcgaggtcgggtcgtttgggaacgggtaaggcgaacgagtagtgaccgaaccggaagagtaggaagggcaaggacgtacgaacgtaacgttaacccgaccgaaccgacccccaaacgaaaccacgtacgtactaacatacgacaactagaaccgagaccgtggaacgagacgtacggaaccgtaccgaccgggtaccgttactaaacgttcgtaggtacgtaccggtaagttaaacgttttacgtttttcgtacggtttactaacgtttaccggttaaacttaacgttttacgtaacgtttagggtaacccttacgttaaggttacggttacgttacgggttccgttacgggtttacccgggggg

SEQ ID NO: 340045 - DNA, 572 bp, Homo sapiens
  misc_feature: GZ8MTXP02H9YR8.17.10.A10.1.454.CMB.2.raw
  modified_base (439)..(439): a, c, t, g, unknown or other
  misc_feature (439)..(439): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccaatcgttggattcaattatgtgtcctggtaccagcaactcccggatcacgcccccaaactcctcatatatgaaagataaataaagcgaccctcgaggggttcccctgaccgtattctctcggctccaagtctggcacgtctcgcccacccgtggcatcaccgcgctccagacgtggggacgaggccgagttactttcgngacgcaaacgagtgggacttccgaagtcctagtacctttcggtgggggttcgttacgggctaggtcgggacccaaggtccgttagaacccggttacccgtaaggtcccaacgaccccgaagggcccttcccgg

SEQ ID NO: 340046 - DNA, 541 bp, Homo sapiens
  misc_feature: GZ8MTXP02FSRTN.17.10.A10.1.454.CMB.2.raw
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccggacaagggcttgaggtggggtggggtgggtcagcggctttggacggtaaggcacagtatgccaccgaagatgaaggcagngtcacgattaccacggacacccccagaaaccacagtctacgatgcaaactgacgagcctgagagcngacgacacgggcctctagttactgtacgcgaagtaacttgttttacngttcattccgtactaaagtttgaataggcttctaagtcggtactgggtacctttggcggggg

SEQ ID NO: 340047 - DNA, 549 bp, Homo sapiens
  misc_feature: GZ8MTXP02JW039.17.10.A10.1.454.CMB.2.raw
  modified_base (371)..(371): a, c, t, g, unknown or other
  misc_feature (371)..(371): n is a, c, g, or t
  modified_base (459)..(459): a, c, t, g, unknown or other
  misc_feature (459)..(459): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtggggtggggtgggtcaggcggcgtttggacggtaaggcacgagtatgccaccgaagataggaagggcagngtcacgattaccacggacacccccagaacacagtcctacatgacaactgaacgagcctgagagctgacgacacgggcctctaattacngtgcgagtaatggttttacngttcagtcgtaactaagtttcgaagttaggcttacgttaatcgggacctggtaacctttcgtaccggggg

SEQ ID NO: 340048 - DNA, 645 bp, Homo sapiens
  misc_feature: GZ8MTXP02JHKT9.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccgggcccccggacgaggaggtcaccatctcttgctctcggaaaccccccatgtgattcaattatgtgtctggtaccagcacgtccggatcacgacccccaaactcctacatatatagaaagaataataacgccgacctacgtacggggttcccctgaccgtattctctcggctccgaacgtcgtggccacgtcgtacgccctacccgtggacacgtccacccgccgcctaccgaacggtacggtacggggaccgacgggcccggtaagtttaacgtttcgtacgccgtacaaacgtacggttacgggtaacttcccgaagtcccgttacgtacgttcggttcgggggttcgttccgggacgtacgggttacggggacccaaacggtccgttacgggaaccccgttccggtaacgggttccgaaccggtacccgaacgggtcccgtccccgg

SEQ ID NO: 340049 - DNA, 575 bp, Homo sapiens
  misc_feature: GZ8MTXP02GP3PF.17.10.A10.1.454.CMB.2.raw
  modified_base (289)..(289): a, c, t, g, unknown or other
  misc_feature (289)..(289): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttgaggtggggtggggtgggtcgaggcggtctttggacggtaggcacgagtatgccaccgagatgaaggcagngtcagattaccgacggacacccccagaacacacgtcacatgacactgacgagcctgagagctgacgacacggccgtactattactgtagcgtagtaacttcggttttctcggttactacgttacgttaacgttaacgtttagaacgtttacgggaacctttacgttagtacgggtaaccgttcggttaccgtttacgggtccggggg

SEQ ID NO: 340050 - DNA, 542 bp, Homo sapiens
  misc_feature: GZ8MTXP02GCAB8.17.10.A10.1.454.CMB.2.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagcgtagactagcacgaccggtgctcgatttagcgtcgatctcaggggacccaaaaaccacacccctccttgggagaatcccctagatcacagctcctcaccatggactggacctggagcacccttttcctggtggcagcaggcacaggtgcccacgcccaggttcagttggtgcagactggggctgaggtgcagaagcctggggcatcagtgactgtctctgcaaggccagtggatatatcttcanaaatatggtatgaattgggtncgacaggcccccgganaagggcttggagtggggtggggtggtcgaggcggctttggacggtaaggcacagtatgcacccgaagatgaagggcagagtcacgattaccacgaccaccccagaacacagtcacatcgcaaactgacgagccagagaagcctggaaccgacgaccggccgtactattactgtgacgagaattcgtttctagtcgtatcgtaactaatttgatagtactctaatcggtaatcggtaacttcggtacggggtaccgg

SEQ ID NO: 340051 - DNA, 713 bp, Homo sapiens
  misc_feature: GZ8MTXP02G7QLN.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccaatgttggattcaattatgtgtcctggtaccagcaactcccgggatcacgcccccaaactcctcatatatagaaagataaataagcgtacccctcgtaaggggttcccctagacccgtatttcctcgtcggtctcccaaagttctcggccaccgtcctcgccccacccgtgggcctaactcccgacccgtccgcctcccgaacggtacgtacgggggaccgacgggaccccggtagttaacgtttccgtcggccgtaccgaaaccgtaaggttcgggggaactttcccgaaggtcccccttagggtaaccgtttccggttggggggttaccggttttccggggccgttaagggggttacccggggaacccgttaaaacggcccggttaacgggtaaacccccgggttccccgttaaacgggggttacccaaccgggtaccccccgaaaacgggggtcccttaaccccccgggg

SEQ ID NO: 340052 - DNA, 590 bp, Homo sapiens
  misc_feature: GZ8MTXP02JO8O2.17.10.A10.1.454.CMB.2.raw
  modified_base (143)..(143): a, c, t, g, unknown or other
  misc_feature (143)..(143): n is a, c, g, or t
  modified_base (507)..(507): a, c, t, g, unknown or other
  misc_feature (507)..(507): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcncggcacaggtgcccacgcccaggttcagttggtgcagactggggctgaggtgcagaagcctggggcatcagtgactgtctcctgcaaggccagtgatatatcttacacaaaatatggtatgaattgggtgcgaccgaggacccccggacaagggctttggagggtggggtggggtgggtcgaggtcggtcgttttggacggtaaggcacgagtatcgaccgaccgaagagtagaagggcagacgtcacgataccacgacacccccagaacacacgtctacatgcaactgacgagcctagagagctagaccgacgacggaccgttactagtttacgtgtacgacgtagtaaagttcgtttttacngttacacgttacgttaacgaagtttagaacgttacggtaactacgttagtcggtacgttcggtaccgtttcggaaaccggggg

SEQ ID NO: 340053 - DNA, 585 bp, Homo sapiens
  misc_feature: GZ8MTXP02IUG6F.17.10.A10.1.454.CMB.2.raw
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaagttgggtgcgacacggcccccggagaaggcttgaggtgggtggggtggtcaggcggtctttggacggtagcacngtangccacgagntgaaggcagngtacacgactaccgacggaccacccccgacgaacacagtctaacatgactaactcggaacgacgccgtagagacgcgtacgaacgaccgaacgggtccctattacgttacgtgtacgacgtaagtagtttcgttttcagttactaacttcgttaaacttagtttacgagtaaggtccttataacggttcggaacgtcggttacgtttcggtaccggggg

SEQ ID NO: 340054 - DNA, 598 bp, Homo sapiens
  misc_feature: GZ8MTXP02JTRLF.17.10.A10.1.454.CMB.2.raw
  modified_base (458)..(458): a, c, t, g, unknown or other
  misc_feature (458)..(458): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccatgttggattcaattatgtgtcctggtaccagcaactcccggatcacgcccccaaactcctcatatatacgaaagataaataacgccgacccctcgtacggggttcccctacgaccgtattcctcgtcggctccgaagtcgtcggtacgtctcgcccacccgtggcactccaccgcgcctcgacgacgtcgggggacacggccgtagttatttccgngccgacaacgtagtcgggtacttccgagtccgtaggtacctttcggtggggttcgttcgggaccgtagggtcggaaccgtaacgccgttacggacccgtcgtacggtaccgacgcccgaacggtcctaccggtccccccg

SEQ ID NO: 340055 - DNA, 557 bp, Homo sapiens
  misc_feature: GZ8MTXP02FVYP7.17.10.A10.1.454.CMB.2.raw
  modified_base (382)..(382): a, c, t, g, unknown or other
  misc_feature (382)..(382): n is a, c, g, or t
  modified_base (532)..(532): a, c, t, g, unknown or other
  misc_feature (532)..(532): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccggacaagggcttggaggtggggtggggcgggtcgaggcggtcgtttggacgggtaagggcacgagtatgaccaccgaagagtaggaagggcaaggngtcaacgattacccgacggaccacccccaagaaacacagtctaacatgacaactggaacgacgcctagagagctagacgacacgggcctactattactgtcgcgtaagtattgtttactgtctacgtcgtaactagtttgattaggcttntactggactggtacttcgtacgggg

SEQ ID NO: 340056 - DNA, 624 bp, Homo sapiens
  misc_feature: GZ8MTXP02JHPEE.17.10.A10.1.454.CMB.2.raw
  modified_base (294)..(294): a, c, t, g, unknown or other
  misc_feature (294)..(294): n is a, c, g, or t
  modified_base (387)..(387): a, c, t, g, unknown or other
  misc_feature (387)..(387): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgtaattgggtgcgacacggcccccgganaagggcttgaggttggggtggggtgggtcgaggcggtacgtttggacgggttaaggcaacgaggtaatgaccgaccgaagataggaaggcagngtcagactaccacggacacccccagaacacagtactacatcgacaacgtgaacgacgaccgtagagagctacggacgaccgaccgggtccgttacgtaagttaccgtaggtacgtaccggtaaagtaagtttcgtttttacgtcgttaccgtaattacccggttaacttaacgttttacgaagttacggtcttacgtagttacggtaacgtcggtttaaccgttcggttaccggggg

SEQ ID NO: 340057 - DNA, 628 bp, Homo sapiens
  misc_feature: GZ8MTXP02FVJTT.17.10.A10.1.454.CMB.2.raw
  modified_base (206)..(206): a, c, t, g, unknown or other
  misc_feature (206)..(206): n is a, c, g, or t
  modified_base (427)..(427): a, c, t, g, unknown or other
  misc_feature (427)..(427): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccgganaggaggtcaccatctctgctctacgaacccccatgtgatcaatatgtgtctgtaccagcacgtcccggatccaccgacccccaaactccctacaactatactagaaagtaataaagtaacgccgacccctcggtacggggttcccctacgtaccgtattctctcggctccgagtcgtggcctacgtctcgccctacccgtggaccacgtccaccgcgtccnccgaggacggtaggggaccgaggcccgtagttacgtttcgcgccgactaacgtacggtcgggtaactttccgaacgtcccgtacgttaccgttcgggtcgggggttcgttcgggacgtaacggttacgggggaaccaacggtcgttaaccggaacccgttacgtaacgggaccaccggacccgaacggtcccgtcccccgg

SEQ ID NO: 340058 - DNA, 517 bp, Homo sapiens
  misc_feature: GZ8MTXP02IFA3A.17.10.A10.1.454.CMB.2.raw
  modified_base (289)..(289): a, c, t, g, unknown or other
  misc_feature (289)..(289): n is a, c, g, or t
  modified_base (414)..(414): a, c, t, g, unknown or other
  misc_feature (414)..(414): n is a, c, g, or t
  modified_base (471)..(471): a, c, t, g, unknown or other
  misc_feature (471)..(471): n is a, c, g, or t
tcagcgtagactagcacgaccggtgctcgatttagcgtcgatctcaggggacccaaaaaccacaaccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacatgcccccgganaagggcttgaggtggggtggggtggtcaggcggtctttggacggtaggcacagtatgcaccgaagatgaagggcagagtcacgattaccgacggacacccccagaacacagtctacatgacaacngacgagcctgagagctagacgacacggcctactattactgtgcgtagaattgtttcngtctatcgtacaatttgataagtctagtatggtactggtacttcgg

SEQ ID NO: 340059 - DNA, 597 bp, Homo sapiens
  misc_feature: GZ8MTXP02HYDK9.17.10.A10.1.454.CMB.2.raw
  modified_base (520)..(520): a, c, t, g, unknown or other
  misc_feature (520)..(520): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccggacaaggggcttggaggtggggtggggtgggtcaggcggtcgtttggacggtaaggcagagtatcgaccgaaccgaagagtaggaaaggggcaaggcgtcaacggtaacttaccgaaccggacccaaccccccgaagaaaccacgagtactaacatcgacaactcgacgacgccgtagagagctaggacgacgacggcctacgtattactgtgacgtagtaatttgttttacngttctaattcggtaacttaagtttgaagttacggtaactcgttaagtcggtacgttcggaccgttttacggcggggg

SEQ ID NO: 340060 - DNA, 602 bp, Homo sapiens
  misc_feature: GZ8MTXP02IUE1N.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgaggtggggtggggtgggtcaggcggtcgtttggacggtaaggcacgagtatgccaccgaagagtaggaagggcagagtcaacgacttacccaccgggaccacccccgaacgaaaccacacgtactaacgatgacaacctgaaccgagcctagagacgcgtaggaccgacgaccgggccgtacttattacgtgtacgcgtaagtaagtttcggttttactgttactacttaccggttaactaacgttttacgagttacggtcttacgttagtcgggtaacttcggtaccgtttcggtaccggggg

SEQ ID NO: 340061 - DNA, 613 bp, Homo sapiens
  misc_feature: GZ8MTXP02JL17A.17.10.A10.1.454.CMB.2.raw
  modified_base (256)..(256): a, c, t, g, unknown or other
  misc_feature (256)..(256): n is a, c, g, or t
  modified_base (360)..(360): a, c, t, g, unknown or other
  misc_feature (360)..(360): n is a, c, g, or t
  modified_base (534)..(534): a, c, t, g, unknown or other
  misc_feature (534)..(534): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacacaaaatntggtatgaattggggtgcgacacggcccccggagaaacgggcttgaggtggggtggggtggtcaggcggctttggacgggtagcacagtatgaccgaccgaagntaggaagggcagagtcaacgattacccgaacgggaccaacccccgaagaaaccacgtacggtacctaacatacgaccaaactcggaaccgacgaccctaggaacgacgcgtacggaccgaccgacggggtccctacgtagtttacctggtgaccgtaagtaatcggtttttccncgttactacgttacgttaacttagttacgagttacgtcgttacgttacgtacggtacgttcggtacgttcgggacgggg

SEQ ID NO: 340062 - DNA, 673 bp, Homo sapiens
  misc_feature: GZ8MTXP02H65MM.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaaatatggtatgtaattgggtgcgacacggcccccggacgaagggcttggaggtggggtggggtgggtcaggcggtcgtttgggacggtaaggcacgagtagtgaccgaccgaagagtaggaaggggcaaggacgtacgaaacgtacgttaaaccccgaaccgggaaccccaaaccccccaaacgaaaccacacgtctaacactacgacaacgtagaaccgacgacccgtagaagacgtacgaggaaccgacgaacccgggtcccgttacttaacgttacgtggtacgtaccggtaagtaaacgttttgtttttccgtagttacgttacttaacggttaaactttaaacgtttacggtaagtaacgggtctttacgtaaagttgggtaaccttaggggtaccgtttcgggtaccggggg

SEQ ID NO: 340063 - DNA, 529 bp, Homo sapiens
  misc_feature: GZ8MTXP02I70TF.17.10.A10.1.454.CMB.2.raw
  modified_base (288)..(288): a, c, t, g, unknown or other
  misc_feature (288)..(288): n is a, c, g, or t
  modified_base (367)..(367): a, c, t, g, unknown or other
  misc_feature (367)..(367): n is a, c, g, or t
  modified_base (478)..(478): a, c, t, g, unknown or other
  misc_feature (478)..(478): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtggggtcaggcggctttggacggtaaggcacagtatgcaccgaagatgaagggcagngtcacgattaccacggacacccccagaaacacagtctaacatgacaacctgaacgagcctgagagctgacgacacgggacctctaattactgtagcgaagaattgttttcngtcatcgtaactatttagataggctctatcggatcggtacttcgtacgggg

SEQ ID NO: 340064 - DNA, 610 bp, Homo sapiens
  misc_feature: GZ8MTXP02GE3UL.17.10.A10.1.454.CMB.2.raw
  modified_base (260)..(260): a, c, t, g, unknown or other
  misc_feature (260)..(260): n is a, c, g, or t
  modified_base (374)..(374): a, c, t, g, unknown or other
  misc_feature (374)..(374): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatntggtatgaagttgggtgcgacgacggcccccggagaagggcttggaggtggggtggggtggtcgaggcggtctttggacggtaaggcacagtatgccacgagagtgaaggcagngtcacgtatacccgacggaccacccccaagaacacacgtcacatgacaactgacgacgacctgaacgacgcgtacggaaccgaccgtaaccgggtcccgtaccttaagttaccgtggttacgacgtaagtaacttcggttttccttggtacctacgttacggttaactaacgttttacgaagttacggtaacttacgttagtacggtaaccgttgggtacctttcgggtacggggg

SEQ ID NO: 340065 - DNA, 657 bp, Homo sapiens
  misc_feature: GZ8MTXP02IM1PY.17.10.A10.1.454.CMB.2.raw
  modified_base (248)..(248): a, c, t, g, unknown or other
  misc_feature (248)..(248): n is a, c, g, or t
  modified_base (420)..(420): a, c, t, g, unknown or other
  misc_feature (420)..(420): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctcctgcaaggcagtgatatatcttanaacaaaatgtggtatgaagttgggtgcgacgacggcccccggacgaagggcgtttggagggttggggtggggtggtcgaggtcggtctttggacgttaaggcagtagtatgaccgaccgagataggaagcgagacgtcaacgacgttaacccgaccggaaccacccccgaanaaaccacacgtactaacagtgaccaacgtgaaccgacgtccgaggacgacgacgtacgaccgaaacgccgggtaccccttagtacttacgtgtacggtaccgtagtaaacgtttcgttttaccgtaggttacctaacgtttaacgttaccgttaaacgtttaagtacgttaaacgggtcccgtttacgtaaggttcccggtaaagttccgggttaacggttcccggttaacgggggg

SEQ ID NO: 340066 - DNA, 673 bp, Homo sapiens
  misc_feature: GZ8MTXP02GSBY1.17.10.A10.1.454.CMB.2.raw
  modified_base (577)..(577): a, c, t, g, unknown or other
  misc_feature (577)..(577): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacaacaaaatatggtatgtaattgggtgcgacgacggcccccggagaagggcttggagggtggggtggggtgggtcgaggcggtcgtttggacggtaaggcacgagtatgacccgaaccgaagagtaggaaggggcaagacgtccaaacggtaacttaacccgaaccgggaacccaaacccccgaacgaaaccacgaacgtactaaacagtacgacctaaacgtacgaacgacgacccgtaggaacggacgtccgtacggaaccgaccgtaccgggtcccgttacgtaacgttacgtgttacggaccggtaagtaaagtttcggttttacncgttaccgtacgttaaccggtaacttaaacgtttacgaagttacggtcttacgttagtacgggacgtttacgggtaaccgtttcgggtaccggggg

SEQ ID NO: 340067 - DNA, 618 bp, Homo sapiens
  misc_feature: GZ8MTXP02IFI86.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtcgtctcgccggcccccggacaggacggtcaccatctcttgctcgtaccggaaacccccctaagtgttggattactaattatgtcgtcctgtaccagccaaccgtccggactaccaccgaccccctaaactcctactatactaatagaaagtaataaactaacgaccgtaccctcggtacgggttcccctagaccgtattctcgtcggcctcctaagtctcgacctaccgtctcgcccctaccgtgggaccacgtccgacccgcgtacctaccgaggtaccggcggggaaccgacggaccgttagttacttcgtacgccgacaaacgtgtaggtaccttcgacgtccgtgtacgttcgtgggtcgttcggactggtacggactacggtctacgaaccgtcgtacggtacacgtacccgagtccgtccccgg

SEQ ID NO: 340068 - DNA, 630 bp, Homo sapiens
  misc_feature: GZ8MTXP02HOJHQ.17.10.A10.1.454.CMB.2.raw
  modified_base (291)..(291): a, c, t, g, unknown or other
  misc_feature (291)..(291): n is a, c, g, or t
  modified_base (382)..(382): a, c, t, g, unknown or other
  misc_feature (382)..(382): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccgganaaggggcttggaggtggggtgggggtggggtcaggcggtcgtttggacgggtaaggtcacgagtagtgccaccgaagataggaagggcagngtcacgattaccgacgaccacccccagaaacacagtctacatgacaactgacgagcctagagagctaggacgaaccgacgggccgttatacgttaccgtggtacgacgtaagtaaagtttcggtttttctaggttacctaagttaccggtttaaacttaaaacgttttcggtaaagtttacggggtccctttaacgtaaggttcgggtaaacccgtttgggttaacccgttttcgggtacccgggggg

SEQ ID NO: 340069 - DNA, 648 bp, Homo sapiens
  misc_feature: GZ8MTXP02J2TEK.17.10.A10.1.454.CMB.2.raw
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagaagccgtgggcatcagtgactgtctcctgcaaggcagtgatatatcttacaataaatntggtatagaagttggtgcgacgacggccccggagagggtcttaggagggtggggtggggtggtcgaggcggttcgttaggacgggtagcgacgtagtatcgacccgacgaagcgtaggaggctaggcgtacgaacgtaccaccgacccgaaccccaaccccgaacgaaacctacgtagtaccctaagacgtacgacgaacgcgaaccggacgtccgagacgacgtcgacggaaccgtacgaaccgggtccttaattacgttagcggtacgaggttaaattcgttttcgtttaccgagtacgtaaccgtttacgtaaacttacgttacgggtaattacggtctacggttagttacggggtacgtttcggtaaccggtttcgggtaacccggggg

SEQ ID NO: 340070 - DNA, 702 bp, Homo sapiens
  misc_feature: GZ8MTXP02I8HC7.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaacaaaatatggtaatgaagttgggtgcgacgacggcccccggagaaggcttgaggtggggtggggtggtcgaggcggtctttggacggtaaggcaacgagtatgaccgaccgaagataggaagggcaggagtcgaacgacttacccgaacggacccaacccccgaagaaaccacaacgtacctaacatcgacaacgtacggaacgacgaccgtaggaacgacggacctacggaaccgaccgaacccggggtcccttaacgtaacgtttaaaccgtgggtacgtaaccggtaaggtaaaacgtttcggttttttaccgtacggtttacctaacgtttaacccggttaaactttaaagtttttaccggaaagtttaacggggttaaccttacgtttaaacggttcgggtaaccgtttacggggttaaccgtttcggggttaaacccgggggg

SEQ ID NO: 340071 - DNA, 634 bp, Homo sapiens
  misc_feature: GZ8MTXP02ILB00.17.10.A10.1.454.CMB.2.raw
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (364)..(364): a, c, t, g, unknown or other
  misc_feature (364)..(364): n is a, c, g, or t
tcagcgtagactagcacgaccggtgctcgatttagcgtcgatctcagggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggccccganaggngtcacatctntnctcgtaccgaacccatgtgatactaatatgtctctcgtacagacaaccgtccggatacgaccgaacccctaaactcctacaataagtatagaaaagtaattaaaagtacgaccgtaccctaggtacggttccccgtacgaaccgtnttcctcgtcggtcctaccgtaattcgtcggacctaacgtctaccgcccctaacccgtgggactacaaccgacccggcgtcctaccgaacgtacgggtacggggaacgaccggtaccggtaaagtttactttacgtcggacctactaaaaccggtaggtacggtacctacgaccgtcgtacgttacgttcgggtcggttacggttcgacgtacggtacggtacgacgtacgtacgtaaccgtacgtacgtacgacgaccgacgtacgtccg

SEQ ID NO: 340072 - DNA, 660 bp, Homo sapiens
  misc_feature: GZ8MTXP02GPNHW.17.10.A10.1.454.CMB.2.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaattgggtgcgacacggcccccggaanaaggggtcttggaggttggggtggggtgggtcgaggcgggtcgttttggacgggtaaggcacgagtagtgaccgaaccgaaagtataggaacggggcaagggacgtaccaacggtaacgttaaccccgaaccggaacccaaaccccccgaacggaaaccacgaacgttacctaacagtcgacaaacgtcgaaacgacgaccctaggaagacgactcgaacgaccgacgggtacctcgtaacgttcgtagtacgacgtagtaagtttcggttttactcggtactacgttaccgtaacgttaacttttaggaacttacggtctttacgtaagttaccgggtattacgggtaccgtttcgggacccggggg

SEQ ID NO: 340073 - DNA, 576 bp, Homo sapiens
  misc_feature: GZ8MTXP02IYYBT.17.10.A10.1.454.CMB.2.raw
  modified_base (291)..(291): a, c, t, g, unknown or other
  misc_feature (291)..(291): n is a, c, g, or t
  modified_base (376)..(376): a, c, t, g, unknown or other
  misc_feature (376)..(376): n is a, c, g, or t
  modified_base (497)..(497): a, c, t, g, unknown or other
  misc_feature (497)..(497): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaattgggtgcgacacggcccccgganaagggcttggaggtggggtggggtgggtcaggcggtctttggacggtaaggcacgagtatgccaccgaagagtaggaagggcagngtcaacggtattacccgacggaccacccccagaaccacagtcaacatgacaactgacgagcctgagacgctggaacgacacgggtccctatattacgtgtagcgaagtaattcgttttcgngttactacgttacgttaacttagtttacgaagttacgtcttacgtagtacggtacgttcggtaccgtttcgggacgggg

SEQ ID NO: 340074 - DNA, 612 bp, Homo sapiens
  misc_feature: GZ8MTXP02GS2SJ.17.10.A10.1.454.CMB.2.raw
  modified_base (289)..(289): a, c, t, g, unknown or other
  misc_feature (289)..(289): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacacggcccccganaagggcttggagtggggtggggtgggtcaggcggtcgtttggacggtaaggcacagtatgccacgaagatggaaggcagngtcaacgataccgacggacacccccagaaacacagtctacatgacaactgaacgacgacctagacgacgctacggacgacacggggccctacgttattacgtgttacgacgtaagtaagttcgttttacgtacggttactacgtttacggtaaccttaaacgttttcggtaacgttagggtaaccctttacgttagttacggggtacgtttacggggtaccgtttcgggtttaacccgggggg

SEQ ID NO: 340075 - DNA, 637 bp, Homo sapiens
  misc_feature: GZ8MTXP02ITDQS.17.10.A10.1.454.CMB.2.raw
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (429)..(429): a, c, t, g, unknown or other
  misc_feature (429)..(429): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtgcgacaggcccccggacaagggcttgaggtgggtggggtggtcagcggctttgacggtagcacngtatgcacgagatgaagggcagngtcgacgattaccgacggacacccccacgaacacagtacctacatgacaactagacgacgcctagaagngctacgacgacacggggccctagtacttaactggtcgacggtaagaaacgtttggtttttaccctaggttaccctaaagttaccccggttaaaacttaaacgtttttaggtaaacgttaacgggggttaacctttaccggtttaaagttacgggggttaaaaccttcgggggtttaaaaccctttaccggggtttaccccgggggggg

SEQ ID NO: 340076 - DNA, 562 bp, Homo sapiens
  misc_feature: GZ8MTXP02FLYH1.17.10.A10.1.454.CMB.2.raw
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (377)..(377): a, c, t, g, unknown or other
  misc_feature (377)..(377): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntggtatgaattgggtgcgacacggcccccgganaagggcttgaggtggggtggggtgggtcgaggtcggctttggacggtaaggcacgagtatgacccaccgaagataggaagggcaagngtcagataccgacggacacccccagaaacacagtctacatgacaactgaacgagcctagagagctagaccgacgacgggccttactattactggtacgcgaagtaattgtttactggtacacgttccgtaaatagtttagattaggcttacgtagtacggtacttgggactttcggtaccggggg

SEQ ID NO: 340077 - DNA, 616 bp, Homo sapiens
  misc_feature: GZ8MTXP02I6879.17.10.A10.1.454.CMB.2.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtacccacgcccaggttcagttggtgcagactggggctgaggtgcagaagcctggggcatcagtgactgtctcctgcaaggccagtggatatatcttacaactaaaatatggtatagaattgggtgcgacaggcccccgganaagggcttggagtggggtggggtgggtcgaggcggtcgtttgacgggttaaggcacgagtatgacaccccgaagagtggaagggcaaggagtcaacgaattaccgaccgaaccaaccccccgagaaacccacacgtctaacactgacaatcgacgagaccagagagagcgacgacgacgaccggtacgtacttacgtagtgtcgagtaagttacgtttgtttacgtacgtacttacgtaaccgttaaagttacgttaacgttaggtaaaccttcgttagttacgtaccggtagttacggtttaacggttcggttaacccggggg

SEQ ID NO: 340078 - DNA, 667 bp, Homo sapiens
  misc_feature: GZ8MTXP02JGBTZ.17.10.A10.1.454.CMB.2.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctgtggcatcagtgactgtctcctgcaaggccagtggatatatcttcacaaatntggtatgaattgggtncgacacggcccccgganaaggggcttggaggtggggtggggtggtcgaggcggctttggacggttaaggcacgagtatcgacaccggaagagtaggaaggggcaggagtcgacgtaacttaaccgaaccgggaaccacccccccgaaacgaaacaaccctaacggtacctaaacgtactacgaccaaacgtcgaaaccggaacgcccgtaggaacgacggacctaggaaccgaaccgaccgggtacccggttactaacgtttaccgtggttcgaccggtaacgttaaaatttcgggtttttacctggttactaacgtttacggtaaccttaaagtttcgaagttaacgggtacctttacgtaacgttaggtacccttagggtacgtttacccgggg

SEQ ID NO: 340079 - DNA, 552 bp, Homo sapiens
  misc_feature: GZ8MTXP02HVCRU.17.10.A10.1.454.CMB.2.raw
  modified_base (367)..(367): a, c, t, g, unknown or other
  misc_feature (367)..(367): n is a, c, g, or t
  modified_base (487)..(487): a, c, t, g, unknown or other
  misc_feature (487)..(487): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggggtggggtgggtcgagcggctttggacggtaaggcacagtatgccaccgaagatagaagggcagngccacgattaccacgggacacccccacgaacacagtctacatgacaactgaacgagcctagagagctaggaaccgacgacgggacccgtactattaacgtgtgcgaagaattgttttacngttcactcggttaactaatttgagttaggcttcgtattcggacttcggtactttcggtacggggg

SEQ ID NO: 340080 - DNA, 579 bp, Homo sapiens
  misc_feature: GZ8MTXP02I3IQB.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaacccccatgttgattcaatatgtntctgtaccagcaacgtcccggatcacgacccccaaactcctacatatatagaaagataaataacgcgaccctcgacggggttcccctagaccgtattctacgtggcctccgaagtcgtggccacgtctcgtcccacccgtgggccacgtccacccgcgcctccgaagacgtacggggacgacggacccgaagtttactttcgtgccgacaaacgtacgtgggtacttccgagtcctagtacttcggtgggggttcgttcggcgtagggtcggaccgagtccgtagaacccgtcgtaacggtcacgtcccgaaggccgtcccg

SEQ ID NO: 340081 - DNA, 580 bp, Homo sapiens
  misc_feature: GZ8MTXP02JHSJA.17.10.A10.1.454.CMB.2.raw
  modified_base (503)..(503): a, c, t, g, unknown or other
  misc_feature (503)..(503): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaaatatggtatgtaaagttgggtgacgacgacggccccccggagaaggcttggaggtggggtggggtgggtcgaggcggcgtttggacggttaaggcacgaggtatgacccacgaagataggaaggcagagtcacgactaccacgaccacccccagaacacagtctacgatgacactgacgagccgagagacgtcacgacgacgacgggcctatacttacgtgtacgacgtaagtaattcggttttacncggttaccagttaccgtaactaacgtttacgagttaggtcttacgtagtacggtacgtcggtacgttacgtcggggg

SEQ ID NO: 340082 - DNA, 527 bp, Homo sapiens
  misc_feature: GZ8MTXP02JT19E.17.10.A10.1.454.CMB.2.raw
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (471)..(471): a, c, t, g, unknown or other
  misc_feature (471)..(471): n is a, c, g, or t
  modified_base (521)..(521): a, c, t, g, unknown or other
  misc_feature (521)..(521): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtgggtcgagcggctttgacggtaaggcacagtatgccaccgaagatgagggcagngtcacgattaccacgacacccccacgaaacacagtctacatgacaactgacgagcctgagngcngacgacacggcctaccgtattactgtcgacgagtaatgttttcnggttcactcgtaactatttagactaggctctatcggtactggacgtttcncggggg

SEQ ID NO: 340083 - DNA, 671 bp, Homo sapiens
  misc_feature: GZ8MTXP02IX1RT.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcgccggcccccggacgaggacggtccaccatctcttgctctacgaaaccccccatgtgattctaatatgtcgtcctggtaccagcaaccgtcccggatccgaccgaccccctaaactccctacaatatatacgaaagtaataaataacgaccgtaccctacggtacggggttcccctacgtaccgtattcctcgtacggcctaccgaagtcgtcggcctacgtcgtcgccctacccgtggacctacgtcccgacccggcgtacctacccgacggtaccggtacgggggaccgacgggtacccggtaagtttacgtttccgtacgacccgtacgaaacgtaggtacggggtacttcccgaacgtccgttacgtacgtttcggtcgggggttcgttcgggcgtaacggtacggaaccgtaagtccgtacgtaacccgttaccgtacggtaccaaccggacccgtaacggcccttcccccgg

SEQ ID NO: 340084 - DNA, 685 bp, Homo sapiens
  misc_feature: GZ8MTXP02H07I4.17.10.A10.1.454.CMB.2.raw
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtncgacgaggcccccgganaaggggcttggaggtggggtggggtgggtcgaggtcgggcgttttggaacggttaaggcaacgagtatgcccgaaccgaagataggaagggcgaagcgtacaacgtaacttacccgaacggacccaacccccaacgaaaccaacacgtactaaccatcgacaaacgtgaacgagtccagaagacgcgtacggacgaaccgacccgggtacccgttagtaacttaacgtcgggtacggtaccgaaaggttaaagtttcggttttttacgtacggtttacccgaaagtttaccggttaaaccttaaaacgtttttcggaaagtttacggggtaaccctttacgtttaaggttacgggtaacgtacgggtttaaaccgttttccggaaccggggggg

SEQ ID NO: 340085 - DNA, 564 bp, Homo sapiens
  misc_feature: GZ8MTXP02H3WZY.17.10.A10.1.454.CMB.2.raw
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttggaggtggggtggggtgggtcgagcggtctttggacggtaaggcacagtatgccaccgagatgaagggcagngtcacgattaccacggacacccccacgaaaccacacgtctacatgacaactgacgagcctgagagctagacgacacggccgtactattacgtgtgcgtaagtaagttcgtttttctggttctagtttaccgtaactacgtttagtaagttaggtcttacgttagttcggtacgtggtaccgttcggtaccggggg

SEQ ID NO: 340086 - DNA, 647 bp, Homo sapiens
  misc_feature: GZ8MTXP02JXPII.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccggagaagggcttgaggtggggtggggtgggtcgaggcggtcgtttaggacgggttaaggcgaacgagtagtggaccgaaccgaagacgtaggaaggggcgaagacggttccaacggtacttaacccgaaccgggacccaaacccccaacgaaaccaacgagtacctacatcgacaacgtgacgagcctagagagctagacgacaccggtccgtactacgttacgtgtcgacgtaagttaagttggtttttcctaggttactaacgtttacccggttaaacttaacgttttacgtaagttacggtaacttacgttaaagttcggttaaccgttacgggtaacgtttccggttaaccgggggg

SEQ ID NO: 340087 - DNA, 558 bp, Homo sapiens
  misc_feature: GZ8MTXP02I883P.17.10.A10.1.454.CMB.2.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaacccccatcgtgatcatangtntctgtaccagcactccggatcacgcccccaaactcctcatatactagaaagataaataagcgtaccccgtgtacggggttcccctagaccgtattcctcgtcggctccaagtcgtgcacgtctcgccctacccgtggccatccaccgcgctccagacgtggggacaggtccgagttatttcgtgcgcaacgagtcgggattccgagcctagacgtttcgtaggggttcgttcggctaagggtcggaccaaaggccttggaacccgttcccgtaagggtccacggtacccccaaggccttccccgg

SEQ ID NO: 340088 - DNA, 651 bp, Homo sapiens
  misc_feature: GZ8MTXP02HWQJ9.17.10.A10.1.454.CMB.2.raw
  modified_base (373)..(373): a, c, t, g, unknown or other
  misc_feature (373)..(373): n is a, c, g, or t
  modified_base (526)..(526): a, c, t, g, unknown or other
  misc_feature (526)..(526): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttcaacaaaatatggtatgtaattgggtgcgacaggccccccggagaagggcttggaggtggggtggggtgggtcaggcggcgtttggacggttaaggcacgagtatgccaccgaagatggaaggcagngtcgacgatacccgacgaccacccccacgaacacagtctacatgacaactgaacgagtaccaggaacgacggtactacggacggaaccgaacccggggccgttactaacgttaacttggtacgaccggtagtaaaagtttcggtttttaccgnggtttacctaagttaccggttaaactaaacgtttttacgggaagtttaaacggggtccgtttaaccggttaaacgttacggggtaaacccgttggggttaaacctttttacggggacccgggggg

SEQ ID NO: 340089 - DNA, 576 bp, Homo sapiens
  misc_feature: GZ8MTXP02GCWJC.17.10.A10.1.454.CMB.2.raw
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttggggttttgggggaagaggaagactgacggtccccccaggagtacaggtgcccacgcccaggttcagttggtgcagactggggctgaggtgcagaagcctggggcatcagtgactgtctcctgcaaggccagtggatatatctnanaaatntgtatgaatgggncgacacggccccganagggcttggagtggggtgggtggtcaggcggctttggacggtaaggcacagtatcgacacgaanagtggaaagggcaggatacgaacgtacttacccgacggaaccacccccaagaaacacagtactacatcgacaactgacgagcctagagagctagaacgaccgacggccctatacgttactggtagacgtaagtaactttgtttctgtctaattcgttaactaagtttgaattaacggtacttacgttaaacgtggtaactcgggtaactttcgggg

SEQ ID NO: 340090 - DNA, 707 bp, Homo sapiens
  misc_feature: GZ8MTXP02JYJCW.17.10.A10.1.454.CMB.2.raw
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
tcagcgtagactagcacgaccggtgctcgatttagcgtcgatctcagggggacccgaaaaaccacacccctccttgggagaatcccctagatcacagctcctcaccatggactggacctggagctatccttttcctggtggcagcaggcacaggtgcccgacgcccaggttcagttggtgcagacgtggggctgaggtgcagaagcctggggcatcagtgactgtctcctgcaaggccagtggatatatcttcacaaaatatggtatgaattgggngcgacaggcccccgganaacgggcttgaggtggggtggggtgggtcagcgccgtttgacggtaggcacagtagtcgacctaccgaagagtacggaacggggcaaggacggtcaacggtaacgttaacccgaacggggaacccaacccccccgaaggaaacccaaccgaaacgttacctaaccatacgaccaaacgtaggaaacccgaggtaccctagggaacggaggaccgttaggaaccgaccgaccggggtaccccgttaccgttaagtttacccgtaggttcggaccggtaaggtaaagttcggtttttaccgtggtttacgaactttaccgggttaaacttaaacgtttacggaacgtttacggggtccttaccggttaacgttcgggtaaaccgtcggggtaaccttttccgggtaaaccgggggg

SEQ ID NO: 340091 - DNA, 674 bp, Homo sapiens
  misc_feature: GZ8MTXP02GL124.17.10.A10.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaagccagtgatatatctacaanaaaatntgtatgaattgggtgcgacgacggcccccggagaagggcttggagggtggggtggggtgggtcgaggtcggtcgtttagggaaccggttaggcaacgaggtatcgacccgtaaccggaagagtaggaaggggcaggacgtaccacgtaacgttaacccgaaccggacccaaccccccgaagaaaccacacgtacaacatacgacaacgtcgaaccgacggacctaggacgacgtacgtacggaccgaaccgaccgggtacccgttacttagtttaccgtggtacgcgtaacgtaagtttcgtttttacgagttacctaacgttaccgttaaacttaaacgttttaggaacgtttacggccgtttaacttacggttacggtaccgttaggggttaccgtttacggggtacccggggg

SEQ ID NO: 340092 - DNA, 591 bp, Homo sapiens
  misc_feature: GZ8MTXP02GNPFL.17.10.A10.1.454.CMB.2.raw
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (377)..(377): a, c, t, g, unknown or other
  misc_feature (377)..(377): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatntggtatgaattgggtgcgacacggcccccgganaagggcttggaggtggggtggggtgggtcgaggcggtcgtttggacgggtaaggcacgagtatgccaccgaagataggaaggcagngtcaacgataccgacgaccacccccagaacacagctaacatcgacaactgaacgagcctaggaagagactagaccgacaccggccgtactagttactgtgacgtagtaattcgttttctcggtactaacgttaccgttaaactaagttttacggaagttaacggtcttacgttagttacgggtaaccgttggtaaccgttttcggtaccggggg

SEQ ID NO: 340093 - DNA, 640 bp, Homo sapiens
  misc_feature: GZ8MTXP02FI5PH.17.10.A10.1.454.CMB.2.raw
  modified_base (290)..(290): a, c, t, g, unknown or other
  misc_feature (290)..(290): n is a, c, g, or t
  modified_base (378)..(378): a, c, t, g, unknown or other
  misc_feature (378)..(378): n is a, c, g, or t
  modified_base (417)..(417): a, c, t, g, unknown or other
  misc_feature (417)..(417): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggccccccgganaagggcttggagtggggtaggggtggtcaggcggtcgtttggacggtaagggcacgagtatgcccgaaccgaagatggaagggcaggngtcaacgattaccgacggtacaacccccaggaaacccanaggttcctaacgatgaccaacgtgaaccgagccctaggaacgcgcgttacggaaccgaccaaccggggtcctacgtacgtttacctggtacgacgtaagtaaacgtttcggttttactacggtacctaacgtttccggtaaacttaagtttttcgaacgtttaacggggcctttaccgtaagttcggggaacctttcggggaaccttttccggtaccgggggg

SEQ ID NO: 340094 - DNA, 598 bp, Homo sapiens
  misc_feature: GZ8MTXP02FP67R.17.10.A10.1.454.CMB.2.raw
  modified_base (290)..(290): a, c, t, g, unknown or other
  misc_feature (290)..(290): n is a, c, g, or t
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccgganaagggcttgaggtggggtggggtggtcgaggcggtcgtttggacggtaaggcacgagtatcgaccgaccgaagagtaggaaggcaggngtacacgacttaccgacgaaccacccccgaacgaaaccacacgtactaacagtagacaacgtgaacgacgacctgacgagcgtagaccgacgaccgggtcctacgtaattacgtcgtgacgtaagtaatttcgttttactgtacctattaccggtaactaagtttagacgttacggtcttacgtacgtcggtacgtacgggtactttcggtaaccggggg

SEQ ID NO: 340095 - DNA, 653 bp, Homo sapiens
  misc_feature: GZ8MTXP02JTG97.17.10.A10.1.454.CMB.2.raw
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcgccggcccccggacaggacggtccaccatctcttgctctaccgaaacccccatgtgatcattatgtgtcctgtaccagcaaccgtccggatccgaccgacccccaaactcctacatatatagaanataaanacgccgtaccctgtacgggttcccctacgaccgtacttctcgtcggctccgaagtcgtggacctacgtctcgccccgaccgtggccacgtccgcccgtaccgccctaccgaacggtacgggtacgggggaccgtacggggacccgtaggtttacgtttccgcgacccgacgaaacgtggttacggggtaccttcccgacggtccttaggtaccgtttcgggtcgggggttaccgttcggggcgtacggggtacgggaacccgaaggtcccgtacggtaacccgttccgtaacggtccaaccggaccccgtaggggtccctcccccggg

SEQ ID NO: 340096 - DNA, 595 bp, Homo sapiens
  misc_feature: GZ8MTXP02I9XVD.17.10.A10.1.454.CMB.2.raw
  modified_base (349)..(349): a, c, t, g, unknown or other
  misc_feature (349)..(349): n is a, c, g, or t
  modified_base (441)..(441): a, c, t, g, unknown or other
  misc_feature (441)..(441): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcaccttctcattcactgcacaggtcctgggcccagtctgtgttgacacagccgccctcagtgtctgccggcccccggacaggacggtaaccatctcttgctctacggaaccccccaatgtgattcaattatgtgtcctggtaccagcaacgtcccgggatccacgcccccaaactccctcactatatagaaagtataaataagcctaccctcgaaggggttccncgaccgattctctggcctcagtctggcacgtctcgccacccgtgggaccatcgaccgcgcctccagaacgtcgggggacaggccgaaggttntttcgtcgcacaactaggtcgggtaacttccgaagtcctacgtactttcggtggggttcggttacggccgtaaggtccggggtaaccaaacggtcctcggttaacccgtccgtaacggtcgaccgacccggaacggcctacccggtccccccgg

SEQ ID NO: 340097 - DNA, 578 bp, Homo sapiens
  misc_feature: GZ8MTXP02GHL3H.17.10.A10.1.454.CMB.2.raw
  modified_base (291)..(291): a, c, t, g, unknown or other
  misc_feature (291)..(291): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaagttgggtgcgacacggcccccgganaagggcttggaggtggggtggggtgggtcgaggcggtcgtttggacggtaaggcacgagtatgccacgaagatgaaggcagcgtcacgattaccgacgaccacccccgaacgaacacagtactacatcgacaactgaacgngccgtagagagctacgacgacgacgggtccttacgtatttacgngtacgcgaagtaagttcgttttctagttactacgttacgtactaagtttacgtaagttaacggtcttacgtagtacggtacgtggtacgttcggtacggggg

SEQ ID NO: 340098 - DNA, 615 bp, Homo sapiens
  misc_feature: GZ8MTXP02HS98S.17.10.A10.1.454.CMB.2.raw
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccggacaggaggtcaccatctctgctctcggaaacccccatgtgnttcaattangtntctggtaccagcaacgtccggatcacgacccccaaactcctcaatatatagaaagataaataacgccgtaaccctcgtacggggttcccctgaccgtacttctctcggactccgtaaagtctcggacctacgtccgtcgcccctacccgtgggaccactccgacccgccgtcctaccgaggacgtcgggggacgacgaccgtaagttctttcgngacgacgaaacngtacgggtattaccgacgtccctagtactttcggtggggttcgttaccgggagtacgggttcggaacccgtacgtccgtcgtaacccggttcgtaacgggtacacggtaccccgaacgggtcccttaccccgg

SEQ ID NO: 340099 - DNA, 849 bp, Homo sapiens
  misc_feature: GZ8MTXP02ICAOR.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgcctcccctctcctcctcacccttctcattcactgcacagggtcctgggcccagtctgtgttgacacacgccgccctcagtgtcgtcggccggcccccggacgagggacggtcaccatctcttgcctcgtaccggaaacccccctaagtcgttaggacttcaattatgtcgtcctggtaccagcaacgtccggatcgaccgaccccctaaactccctacaactataactagaaaacgtaaataaataaacggacccgtaaccccgttggtacggggtttaccccctacggtacccgtaactttccgttcgtacggtcccttacccgaaacgtttccgtcgggtaccctaccggttcccgtacgtacccccgaaccccgtcgggggacccttaacgttccccgaaccccggcccgtacccgtaccccgaaacggttacccggtaccggggggacccgaacggggtaccccggttaaggttttacctttcggtacggaccgtacgtaaaacgtacgttacgggggtaactttacccggacgttacccggttcggttacccgtttcgggttcggggggtttacgttcccgggggtacgtaacgggggttaccgggggtaaaacccgaaacggttccggtaacccggggtaaacccccgggttttcccggttaaaaccgggggtccgtaaaacccccgggtcccccggaaaaccgggggtttacccgtttaccccccccggggg

SEQ ID NO: 340100 - DNA, 649 bp, Homo sapiens
  misc_feature: GZ8MTXP02GVOHG.17.10.A10.1.454.CMB.2.raw
  modified_base (261)..(261): a, c, t, g, unknown or other
  misc_feature (261)..(261): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatntggtatagtaagttgggtagcgacgacggcccccggagaagggtcttaggagggtggggtaggggtgggtacgaggtcgggtacgtttagggaccgggttaaggccaagtaggtagtcggacccgaaccggaaagagtaggaaggggcaaggcgtacgaacgtaacgttacccgaaccggaacccacccccgaacgaaaccactacgtacacatacgacaacgtagaacgacgccgagaaggacgacgtacggaaccgaccgaccgggtaccgttaccttaagttaccgtggtacgacgtagttaacgttggtttactgttactacgtaccgttaactagtttgagttacgctactagtacggactacggtacgttacggaccggggg

SEQ ID NO: 340101 - DNA, 583 bp, Homo sapiens
  misc_feature: GZ8MTXP02GZL0N.17.10.A10.1.454.CMB.2.raw
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttggaggtgggtggggtgggtcgaggcgggtctttgggacggtaaggcacgtagtatgaccaccgaagactaggagggcagngtcacgacttacaccggacacccccanaacacagtctacatgacaactgacgagcctagaagagacgtagacgacgaacgggcccgtacgtacttacgtgtacgccgtaagtaattgttttactgttcctagttccgttaactaagtttacgtagttaacggtcttacgtagtacggtacttacgggtacgtttcggtaccggggg

SEQ ID NO: 340102 - DNA, 557 bp, Homo sapiens
  misc_feature: GZ8MTXP02G80XD.17.10.A10.1.454.CMB.2.raw
  modified_base (499)..(499): a, c, t, g, unknown or other
  misc_feature (499)..(499): n is a, c, g, or t
tcagcgtagactagcacgaccggtgctcgatttagcgtcgatctcaggggagctctgcttcagctgtgagcgcagaaggcaggactcgggacaatcttcatcatgacctgctccctctcctcctcacccttctcattcactgcacagggtcctgggcccagtctgtgttgacacagccgccctcagtgtctgcggcccccggacaggaggtcaccatctcttgctctcggaaacccccccaatcgttggattcaattatgtgtcctggtaccagcaactcccggatcacgcccccaaactcctacatataatagaaagaataaataaacgaccgtaacccctcgtaggggttccccctagaccgtattcctctcggctccaaagtctaggcacgtctcgcccacccgtggacatccaccgcgctcccgagaccgtggggacaggccgagttattcgtgcgacaacagtgggacttccgagtcctagacttcgtggggtnttcggctaggtcggaccaagcctagaaccgtcctaggccagaccccaaggcctcccgg

SEQ ID NO: 340103 - DNA, 549 bp, Homo sapiens
  misc_feature: GZ8MTXP02I7KRO.17.10.A10.1.454.CMB.2.raw
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacatgtgcccacgcccaggttcagttggtgcagactggggctgaggtgcagaagcctggggcatcagtgactgtctcctgcaaggccagtggatatatcttcacaaatatggtatgaattgggtgcgacacgggcccccgganaagggcttggaggtggggtggggtgggtcaggcggcgtttggacggtaaggcacgagtatgcaccgagataggaagggcagagtcacgattaccgacggaccacccccaacgaacacagtactacatgcaactgacgagcctgagagctgacgacgaccggccgtactattacgtgtgacgagtaattcgtttctgtactattacgtactaagtttgaagttaacggtcttacgttagtggtacttcggtactttcgggg

SEQ ID NO: 340104 - DNA, 677 bp, Homo sapiens
  misc_feature: GZ8MTXP02JUWRY.17.10.A10.1.454.CMB.2.raw
  modified_base (393)..(393): a, c, t, g, unknown or other
  misc_feature (393)..(393): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcagacacaggtgcccacgcccaggttcagttggtgcagactggggctgaggtgcagaagcctggggcatcagtgactgtctcctgcaaggccagtggatatatcttacacaaatatgtatagaattgggtgcgacgacggcccccggagaagggccttggagggttggggtggggtgggtacgaggcgggtcgtttagggacgggttaaggcgacgagtagtgacccgaccgaagataggaaggggcaaggngtcagtacttaccgacggaccaacccccacgaaacactacgtctaacatacgacaacgtacgaaccgcgtacctaggacgacgacgtacggaaccgaccgtaccggggtcccgttacttaacgtttaccgtagggtacggtaccggtaaggtaaaacgtttcggtttttaccgtacggttacgtaaacgttaccgttaaaccgttaaactttttggaacgtttagggtcccttaagttacggtacgggtaccgtagggtttaaccgtttcgggtaacccggggg

SEQ ID NO: 340105 - DNA, 636 bp, Homo sapiens
  misc_feature: GZ8MTXP02GWLKZ.17.10.A10.1.454.CMB.2.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcgaacccccatgtgatcatngtntctgtacagcaactccggatcacgccccaaactcctacatatatagaagataataagccgtaccctcgacggggttcccctagaccgtattctcgtggcctccgaacgtcgtggcctaccgtcgtacgcccctacccgtgggaccacgtcccgacccgcgtcctaccccgagtaccggtcgggggacgacgggtaccgtagttactttcgaggaccgtaccaaagtcgtacggggtacttcccgaacgtccccgttaagtacccgtttcgggttgggggtcgtttccgggacgtaagggttacggggaaccctaacggtccgtacggtaacccgttccgtaacgggtccaccggaccccgtaacggggtcccttacccccgggg

SEQ ID NO: 340106 - DNA, 601 bp, Homo sapiens
  misc_feature: GZ8MTXP02I7IT1.17.10.A10.1.454.CMB.2.raw
  modified_base (258)..(258): a, c, t, g, unknown or other
  misc_feature (258)..(258): n is a, c, g, or t
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
  modified_base (525)..(525): a, c, t, g, unknown or other
  misc_feature (525)..(525): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatntggtatgaattgggtgcgacaggcccccgagaaggcttggaggtggggtggggtggggtcaggtcgggtcgttttaggacgggttaaagggcacgaggtatgacccaaccggaagagtaggaaggggcaagagtcgaacgtacttacccgaaccggaccaccccccgaanaaaccacaagtcctaacatcgacaacgtgacgagccagagagacgtgacgacgacgggccgtactattaccgngtggacgtaggtatggtttttacncgtactacgttacgttaacttaacgtttgtagtacggtcttacgtagtacggtacgtcggtaccgttcggtcgggg

SEQ ID NO: 340107 - DNA, 598 bp, Homo sapiens
  misc_feature: GZ8MTXP02JY7ZL.17.10.A10.1.454.CMB.2.raw
  modified_base (293)..(293): a, c, t, g, unknown or other
  misc_feature (293)..(293): n is a, c, g, or t
  modified_base (387)..(387): a, c, t, g, unknown or other
  misc_feature (387)..(387): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (512)..(512): a, c, t, g, unknown or other
  misc_feature (512)..(512): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacacaaaatataggtatagaagttgggtgcgacgacggccccccgganaagggcttggaggtggggtggggtgggtcgaggtcggtcgtttgggacggtaaggcacgagtacgtgcccaccgaagagtaggaagggcaaggngtcaacggtacttaccgacgggaccaacccccagaaccacagtctacatgacaactgaacgagcctgagngcgngacgacgacggccgtactattacgtgtacgacgtagtaagttggttttacncggttaactacgttaccggtaactaacgtttgaacgttaggtccttacgttaacgtggtacgtacggtacgttcggttaccggggg

SEQ ID NO: 340108 - DNA, 675 bp, Homo sapiens
  misc_feature: GZ8MTXP02IPG49.17.10.A10.1.454.CMB.2.raw
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaaatatggtatgaattgggtncgacacggcccccgganaagggcttggaggtggggtggggtggtcgngaggcgtttggtacgggtaaggacgacagtaagtgtccgaccgaacgaagtagaagggacgagaggtacgtacgaacgttaaaccgtacccgggaaccaaaccccccgaacccgaaaacgtaccaacggtacctaacaatcgtacaaccgtagacgaagcccgtagaaggacgtacggcgtaacggaacccgacggtacccccggttacttacgtttaccttaggtacgaccggtaagtaaacgtttacgttttcgtttcgtattacgttacgttaaaccgttagttttaacgttagttaaacggtcttacgtaaggtttacggagttacggttacggtttaccggtttacgggggg

SEQ ID NO: 340109 - DNA, 699 bp, Homo sapiens
  misc_feature: GZ8MTXP02HHQHW.17.10.A10.1.454.CMB.2.raw
  modified_base (252)..(252): a, c, t, g, unknown or other
  misc_feature (252)..(252): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcagacacaggtgcccacgcccaggttcagttggtgcagactggggctggaggtgcagaagccgtggggcatcagtgactgtctctgcaggccagtggatatatcttacaanaaaatatggtatgaagttgggtgcgacgaccggcccccggaagaacgggtcttggagggttggggtggggtgggtcgaggcggtcgtttggacggtaaggcaacgtagtagtcgacccgaccgaagacgtagggaaggcaaggacgtacgaacgtacgttaacccgaaccggaacccaaccccccgtaaacggaaaccaaccgacggtacctaacgaagttacgaccgtaaaccgtacggaaaccggacgtacccgtaggaaacgacgtaccgacggaaccgaacccgaccgggtacccgttacgtttaacgttaccgtggtacgtacggtaaagttaagtttcgtttttaccgtacggtttacctaacgtttacgttaacttaagtttcgtaagttacggtcttacgttagtacggtacgttcggtaccgtttacggtaccggggg

SEQ ID NO: 340110 - DNA, 659 bp, Homo sapiens
  misc_feature: GZ8MTXP02JA953.17.10.A10.1.454.CMB.2.raw
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
  modified_base (567)..(567): a, c, t, g, unknown or other
  misc_feature (567)..(567): n is a, c, g, or t
tcagcgtagactagcacgaccggtgctcgatttagcgtcgatctcaggggacccaaaaaccacacccctccttgggagaatcccctatatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtgcgacacggccccganaagggcttgaggtgggtggggtgggcaggcggtctttagggacggtaaggcacgtagtatcgaccgaccggaaagacgtaggaacggggcaaggacggtacaacggtaacttacccgaccgggaacccaaccccccgaacgaaaccactaacgttactaacacgtagacctaacgacggaacgaacgccctaggaaggacgacgtacggaaccgacccgaccgggtacccgttactaacgtttaccgttgacggtcgtaaagtaaacttcgtttttacgngttactactaccggttaaacttacgtttagtaagttacggtaacttacgttaaggtacggtaacgtttcggtaaccgtttcgggaccggggg

SEQ ID NO: 340111 - DNA, 624 bp, Homo sapiens
  misc_feature: GZ8MTXP02FIR20.17.10.A10.1.454.CMB.2.raw
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcgaggcggtcgtttggacggtaaggcacgagtatgaccaccgaagatgaagggcaggngtcacgattaccacggacacccccagaacacagtctaacatcgacaaacgtgaacgagacccgtaggaagagctaggaaccgacaaccggggccgtaccttaagttaacctggtacgacggtaagtaaagttcggtttttactcggttacctaagttcggttaaacctaaagtttttacgaagtttaacgggtctttacgttaacgttaggggtaacctttacggggtaaccttttcggtaaccgggggg

SEQ ID NO: 340112 - DNA, 694 bp, Homo sapiens
  misc_feature: GZ8MTXP02G6HTF.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatagaagttgggtgcgacacggcccccgagaaggcttggaggtggggtggggtggtcgaggtcggtcgtttgggacggtaaggcaacgagtagtgacccaacgaagagtaggaagggcaaggacgtcaacgaacgttacccgaccggacccaacccccaacgaaaccacgaacgtctaacatacgacaacgtcgaacgacgaccgtagaagacgacgacggaaccgaccgaccgggtaccgttacgttaacgttacgtcggtacggtaccgtaaaggttaactttcgggtttttacctacgggtttacctaaacgtttaccggttaaacttaaacggttttagtaaccgtttaaggggtccctttaaggtttaacggttacgggttaaccgtttacggggttaaacccgtttcggggttaacccgggggg

SEQ ID NO: 340113 - DNA, 524 bp, Homo sapiens
  misc_feature: GZ8MTXP02FLJHF.17.10.A10.1.454.CMB.2.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
  modified_base (473)..(473): a, c, t, g, unknown or other
  misc_feature (473)..(473): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccgganaagggcttgaggtggggtggggtggggtcaggcggctttggacggtaaggcacgagtatgccaccgaagatgaagggcagngtcacgataccacggacacccccagaaacacagtctacatgcaactgacgagcctgagagctgacgacacggccgtctattactgtgcgagtaatgttttacngtacatcgtacaatttgataggctactatggtactggacttcgtacggggg

SEQ ID NO: 340114 - DNA, 637 bp, Homo sapiens
  misc_feature: GZ8MTXP02FNFRR.17.10.A10.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (383)..(383): a, c, t, g, unknown or other
  misc_feature (383)..(383): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttnaacaaaatntggtatgaattgggtgcgacgacggcccccgganaagggcttggaggtggggtggggtgggtcgaggcggtcgtttggacggtaaggcacgagtatgaccaaccgaagagtggaagggcaagngtcacgtattacccgacggaccaacccccaagaaacacaagtctacatcgacaacgtcgaacggacgaccgtagaacggtacgcctaggaaccgaccgaccggggtcccttaccgttaagttaccgttggtacggacggtaagttaagtttcggtttttacctggttaccttaacgttacgttaaacttaaagttttacggatttaacgggccttacgtaagtcgggacttacgggtacctttcggtacggggg

SEQ ID NO: 340115 - DNA, 600 bp, Homo sapiens
  misc_feature: GZ8MTXP02I69X5.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatctacaacaaaatatgtatgaattgggtgcgacacggcccccggagaaggcgttgaggtggggtggggtgggtcgaggcggtcgtttaggaacgggtaaggcgaacgagtagtcgaccgaaccgaagagtaggaagggacagagtcgaacgtacttacccgaccggacccaacccccgaacgaaaccacgagtactaacatgacaactacgacgacgccgtagagagcgtacgacgaccgacggaccgtactagttactgtacgacgagtaatcggttttctgtctacgtacgtactaagtttacgagttaggtcttacgtagtacggtacgtcggtacgttcggtaccggggg

SEQ ID NO: 340116 - DNA, 589 bp, Homo sapiens
  misc_feature: GZ8MTXP02GN4NT.17.10.A10.1.454.CMB.2.raw
  modified_base (485)..(485): a, c, t, g, unknown or other
  misc_feature (485)..(485): n is a, c, g, or t
  modified_base (528)..(528): a, c, t, g, unknown or other
  misc_feature (528)..(528): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgtggattcaattatgtgtcctggtaccagcaacgtcccggatcgacgacccccaaactcctcaatactatagaaagaactaaataaagccgaccctcgtaacggggttccccctagacccgtaatttccgtcgttcggaccttcccgaaagttcgtacggacctaccgttctcgcccaacccgtgggacccaatccacccgcgtcctaccgagactgggggaccaggcccgagttatttcngcgtacaacagtgggacttccagcctagtacttcgtgggggtnttacgactaggtcgggacaacgcgtacgaacccgtctacggcacgaccgaacggctcccgg

SEQ ID NO: 340117 - DNA, 694 bp, Homo sapiens
  misc_feature: GZ8MTXP02GXKAA.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgtaagttgggtgcgacacggacccccggagaaggggctggagggtggggtggggtggtcgaggcggtcgtttgggacgggttaaggctaacgtaggtagtcggaccgaaccggaaagagtagggaaacggggccaagggacggttacaaacggaacgttaacccgaaccgggaaccccaaaccccccgaaaccgaaaccaaccgtaacggtacctaacgaactacggaacctaaaccgtggaaccgacgaccgtaggacggacgtcgtacggacgaccgaccggggtacccttacgttacgttaccgtggtacgacggtaacgttaagtttggtttttaccgtaggttacctacttacggttaactaacgtttagacgtttaggaacttacgtaggtacggtacgttcggtacgtttcgggtaccggggg

SEQ ID NO: 340118 - DNA, 622 bp, Homo sapiens
  misc_feature: GZ8MTXP02GPF53.17.10.A10.1.454.CMB.2.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaaatatggtatgaattgggtgcgacacggcccccgganaaggcttgaggtggggtggggtgggtcgaggcggtcgtttgggacggttaaggcaacgagtatgccaaccgaagagtaggaagggcaggagtcaacgacttacccgaccgggaaccacccccaacgaaaccacgaacgtacctaacatacgacaaactacggaacgacgaccgtagaaggacgctacggaacgacgacgggccgtactaacgttacgtgtcgacgagtaattgttttcgtgttactattaccggttaactaagttttacgaagttacggtaacgttacttagttacgggtacttcgggtaacctttcgggtaaccggggg

SEQ ID NO: 340119 - DNA, 634 bp, Homo sapiens
  misc_feature: GZ8MTXP02GV6RA.17.10.A10.1.454.CMB.2.raw
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattggggngacgacgaccggaccccggagaaggtcttggagggttggggtggggtggtcgaggtcggtcgtttaggacggtaaggacacgagtagtcgacccgaacgaagagaggaaggcgagacgtacgaacgtactaccgaaccggaacccaacccccgaaacgaaacctaacacgtaacctaacatacgacgaactacgacgacgacgtacgagacgacgacgacgacgaccgtaccgtacgtaacgttacgtacgtacggacgtacgtagttacgtttacgttacgttactacgttacgtaacgttaacgtttacgtagtacgtaacgttacgttacgtacgtacgtacggtacgttacggtcggg

SEQ ID NO: 340120 - DNA, 736 bp, Homo sapiens
  misc_feature: GZ8MTXP02GSGCM.17.10.A10.1.454.CMB.2.raw
  modified_base (217)..(217): a, c, t, g, unknown or other
  misc_feature (217)..(217): n is a, c, g, or t
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (524)..(524): a, c, t, g, unknown or other
  misc_feature (524)..(524): n is a, c, g, or t
  modified_base (536)..(536): a, c, t, g, unknown or other
  misc_feature (536)..(536): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcactcgngtacgtcgttcgtcctcgtcgacggacggacgtaggtagtatattacttactacaaataaatggtagtagtagtaggttggcgacgacggccccggaccgaaggacggtgtaggnggggtggggtggggtcggaggcggtcggtttcggtacgggtaacgggacgaccgaagtagtacgacgaaccccgaaaggagtaggaacggggaacggngaacggtacgtaccgtaaacgtaacccgtaaccggaacccgaaccccaaccccggaaacaaccgacgtactacactacgacaacctagacgacncgtacgagaacncgtacgacgaccgacggtccggtacttacgttaacgtgtcggaacgtaagttaagtttcgttttccgttagtaccggtactttaacccgggtttaaacttaaacggttttaggttaacgtacggggtttactaacccgtttaacggttagggttacggttaccggttacgtttaaccggggtttcggggggaaccccggg

SEQ ID NO: 340121 - DNA, 555 bp, Homo sapiens
  misc_feature: GZ8MTXP02JSQZF.17.10.A10.1.454.CMB.2.raw
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
  modified_base (488)..(488): a, c, t, g, unknown or other
  misc_feature (488)..(488): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattggggtgcgacgaggcccccggacaagggtcttggaggtggggtggggtgggtcgaggtcggtcgtttggacggtaaggcacgagtatgccacgagatggaaggcagngtcagtataccgacggacacccccagaaccacagtctacatcgacaactgacgagcctagagcncgtgacgacaccgggcctactattacgtgtgcgagtaattgtttttacncgttactacgtacgtactaaagtttcgaattacggcttctaagtcggaactcggtactcgtacgggg

SEQ ID NO: 340122 - DNA, 702 bp, Homo sapiens
  misc_feature: GZ8MTXP02GTQYW.17.10.A10.1.454.CMB.2.raw
  modified_base (259)..(259): a, c, t, g, unknown or other
  misc_feature (259)..(259): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatntggtatgtaagttgggtgcgacgacggcccccggaagaagggcttgaggtggggtggggtgggtcgaggtcggtcgtttaggacggtaaggcaacgagtagtgacccgaacgaagagtaggaagggcaagagtacgaacgtacgttaaccgaaccgggaaccaaaccccccgaacgaaaccaccgaacggtacctaacagtacgaaccaacgtacgacgaacgtaccgtaggaaacggacgaccgtacggaacccggaaccgaacccggggtaccgttaccgttaacgttacccgtaggtacgtaccggtaaggttaaacgtttacgggtttttcttaccggttaacttacgttacccggttaaacttaacgttttaggaacgttacggtaacttaccgttaagttacggtacgttacggtaccgtttcgggttaaccggggg

SEQ ID NO: 340123 - DNA, 555 bp, Homo sapiens
  misc_feature: GZ8MTXP02G4FDI.17.10.A10.1.454.CMB.2.raw
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtggggtggggtgggtcagcggctttggacggtaaggcacgagtatgccaccgaagatgaaggggcagngtcacgataccacggaccacccccacgaaacacacgtctacatgacaactgaacgagcctagagagctagacgacgaccggaccgtctagttactgtgacgagaaagttgttttctggtactacttcgtaactaagtttcgtattaggtcctacgttatacggtacttggtaactttcggtcggggg

SEQ ID NO: 340124 - DNA, 618 bp, Homo sapiens
  misc_feature: GZ8MTXP02FZ0TY.17.10.A10.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagtacaggtgcccacgcccaggttcagttggtgcagactggggctgaggtgcagaagcctggggcatcagtgactgtctcctgcaaggccagtgatatatctcaacaaatntggtatgaattgggtncgacacggcccccgganaagggctggaggtggggtgggtggtcaggcggtcttggacggtaaggcacgagtactcggacaaccgtaagagtaggaagggcaggagtcaacggtactacccgacgggaacccacccccgaagaacaccgagtactacatacgacctaagtcggaacgacgcctaggacgacgcgtaggaccgaccgaaccgggtcccttactaacgttcgtaggtcgacggtaagtagtttcgtttacgtgtaccgtagttccgtaaacttagtttcgaagtaacggtcctagttacgtacggtacgttacggtacgtttccgggg

SEQ ID NO: 340125 - DNA, 710 bp, Homo sapiens
  misc_feature: GZ8MTXP02I4JCD.17.10.A10.1.454.CMB.2.raw
  modified_base (256)..(256): a, c, t, g, unknown or other
  misc_feature (256)..(256): n is a, c, g, or t
  modified_base (641)..(641): a, c, t, g, unknown or other
  misc_feature (641)..(641): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaggcagtgatatatcttacaacaaaatntaggtatgtaagttgggtgcgacagtccggacccccggaagaacggggcttagggagggttgggggtgggggtcggggtccgagggtccggggttacgttttcgggaacggggttaaacggccgtaacgtaaggtactcggacccgaaaccgggaaagaggtaggggaaacggggcagggaacgttacgaaaccggtacttaaaccccggaaccggaaccccaaaccccccgaaacgaaacccgaaaccgtacggtacccaaacgtaactacggaaccaaacgtaggaacgaccgccgtaggaacggacgtcgtacggaaccgaccggtaccggtacccgttactacgtttacgtcggtaggacgtaagtacgtttcgtttaccngttacctattacctacgtaaatttgaagtaacggtcttacgtacgtggtacgttcggtacgtttcgggg

SEQ ID NO: 340126 - DNA, 625 bp, Homo sapiens
  misc_feature: GZ8MTXP02F7ES1.17.10.A10.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttnaacaaaatntggtatgtaagtgggtgcgacgacggcccccggagaaggcttgaggtggggtggggtggggtcaggcggtcgtttaggacggttaaggcacgagtatgaccaccgaagagtaggaaggcagcgtacgacgtactaccgacggacccaacccccgagaaaccacacgtacctaacactagaccaacgtcgacgacgccgtagagacgcgtacggaaccgaccggaccgggtaccgttacgtacgtttacgtaggttacggacgtaagttaagtttcggttttacgtcgttacgtaacttccggttaaacttagtttacgagttacggtcttacgtagtacggtacgttcggtacgtttcggtaccgggg

SEQ ID NO: 340127 - DNA, 662 bp, Homo sapiens
  misc_feature: GZ8MTXP02JQ3ZB.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggagaagggcttgaggtggggtggggtgggtcgaggcggcttttggacgggtaaggcacgagtatgaccaccgaagacgtggaaaggggcaggacgtacgaacgaacgttacccaccggggaacccaaaccccccgaacggaaaccaaccaacggtacctaaccatacgacaactggaaccgagaccctgaagagcgagaccggaacacgggacccgttactaacgttaacgttggttacgacgtaaggtaatttacggttttttaccggtcgttaccgtaacgttaccggttaaacttaaacgttttacgttaagtacggttaaccgttacggtaacgtacgggtacgttacgggttaccggttacggtacggggg

SEQ ID NO: 340128 - DNA, 629 bp, Homo sapiens
  misc_feature: GZ8MTXP02G0RP7.17.10.A10.1.454.CMB.2.raw
  modified_base (331)..(331): a, c, t, g, unknown or other
  misc_feature (331)..(331): n is a, c, g, or t
  modified_base (457)..(457): a, c, t, g, unknown or other
  misc_feature (457)..(457): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatgaagttgggtgcgacacggcccccggagaagggcttggaggtgggtggggtgggtcaggcggtntttggacgggtaaggcacgagtagtgaccgaaccgaagagtaggaagggcaaggagtccgaacgacttaacccgacggaacccacccccaacgaaaccacagtctaacatcgacaacgtgaacganccgtagagagctacggacgacgaccgggtcctacttaagttaccgtaggtacgacggtaagttaaacgttggtttttaccgtcggttactaacgttaccgttaaactaaagttttcggaagttacggtcttacgtaagtcggtaacgttcggtaccgttcggtacccggggg

SEQ ID NO: 340129 - DNA, 656 bp, Homo sapiens
  misc_feature: GZ8MTXP02JEKKV.17.10.A10.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttacanaaaatntagtatagaattgggtgcgacacggccccganaaggctgaggtgggtggggtggtcaggcggtgtttaggacggtaaggcaacgagtatcgaccaaccgaagataggaacgggtcagagtcgaacgtacttacccgaacggacccaaacccccgaacggaaacccacgacgtcctaaacacgtacgaccaacgtacgaaccgagtacccgtagacggtacggcgttacggaaccgacccgtaccgggtacccgttcgtaaacgtttaccgtcgggtaagtacggtaagttaaactttcggtttttacgtaggttacccttaaagttaccgttaaactagtttttagaacgtttaggtccttagtacgtggtacttacggtaccgttcggtaccggggg

SEQ ID NO: 340130 - DNA, 569 bp, Homo sapiens
  misc_feature: GZ8MTXP02IU7EV.17.10.A10.1.454.CMB.2.raw
  modified_base (373)..(373): a, c, t, g, unknown or other
  misc_feature (373)..(373): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacacggcccccggagaagggctttggaggtggggtggggtgggtcgaggcggtcgtttggacggtaaggcacgagtatgccacgagatggaaggcagngtcacgattaccacggaccacccccagaacacagtactacatgacaacctgacgagcctgagagctacgacgaccgacggcccgtacttacgttacgtgtagcgtaagtaacgttgttttacgtgtactacttacgtaactagtttacgagtacggtcttacgtagtacggtactacggtactttcggtacggggg

SEQ ID NO: 340131 - DNA, 526 bp, Homo sapiens
  misc_feature: GZ8MTXP02FF201.17.10.A10.1.454.CMB.2.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtgggtcagcggctttgacggtaaggcacagtatgccaccgaagatgaagggcagngtcacgattaccacgacacccccagaaacacagtctacatgacaactgaacgngacctagagagctgacgacacgggctcctattactgtgcgagtaagttgtttactgtactagtaccgtaactaatttcgattaggctcgtatggactggacttcgtcgggg

SEQ ID NO: 340132 - DNA, 621 bp, Homo sapiens
  misc_feature: GZ8MTXP02H9I26.17.10.A10.1.454.CMB.2.raw
  modified_base (292)..(292): a, c, t, g, unknown or other
  misc_feature (292)..(292): n is a, c, g, or t
  modified_base (383)..(383): a, c, t, g, unknown or other
  misc_feature (383)..(383): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaagttgggtgcgacgacggcccccgganaagggcttgaggtggggtggggtgggtcgaggcggtctttgggacggttaaggcacgtagtagtgacccaaccgaagataggaagggcagngtcacgacttacccacggaccaacccccacgaaaccacacgtactacatagacaactagacgacgcctagagacgctacggacgaccgacggccgtactagttactgtacggcgtaagtaagtttcgttttcgtagttaccgtaatttccggtaaactttaacgtttaacgtaagtttaacgggtccttacgttaaagttcgggaaccgttcggtaacccgtttcggtaacccggggg

SEQ ID NO: 340133 - DNA, 752 bp, Homo sapiens
  misc_feature: GZ8MTXP02HPYNY.17.10.A10.1.454.CMB.2.raw
  modified_base (533)..(533): a, c, t, g, unknown or other
  misc_feature (533)..(533): n is a, c, g, or t
tcagcgtagactagcacgaccggtgctcgatttagcgtcgatctcagggacccaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaaggccgtggggcatcagtgactgtctcctgcgaaggccagtggatatatcttacaaacaaaatagtggtaatagtaagttgggtagcgaacgacgggccccccggaagtaagggtcttaggagggtggggtaggggcgggtagaggtcggggtcgtttagggaacgggttaaaggccaaagaaggtaattcggacccgaaccggaaaggataggggaaaagggcaagggacgtaccgaaacgtaacgttaaacccgaacccggggaaacccaaaccccccccgaaggaaaacccaacgtaacggtacctaaaaccgagttacgaacctaaaccgnggaaaccgaacgtcccgtaggaaaggtacggaccgttaacggaaccgaaccgtaacccggggtcccgttacttaagttacccgttggtacgaccggtaaaggtaaattttcgggtttttccacggtttactaacgttaccgttaaacgttaacgtttagtaacgttacgtcgttacgttaggtacggtaccgtttacggtaccgtttacgggacggggg

SEQ ID NO: 340134 - DNA, 577 bp, Homo sapiens
  misc_feature: GZ8MTXP02IVXV4.17.10.A10.1.454.CMB.2.raw
  modified_base (290)..(290): a, c, t, g, unknown or other
  misc_feature (290)..(290): n is a, c, g, or t
  modified_base (371)..(371): a, c, t, g, unknown or other
  misc_feature (371)..(371): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtgcgacaggcccccgganaagggctgaggtgggtggggtgggtcaggcggtcgtttggacggtaaggcacgagtatgccaccgaagagtggaaggcagngtcacgattaccgacggaccaacccccagaacacagtactacatgacaactgacgacgcctgagagctgacgacacggaccgtactagttacgtgtacgacgtaagtaattcggttttctgttacctaagttacggtaaacttaagtttacgaagttacggtcttacgttagtacggtaactcggtaacgtttcggtaaccggggg

SEQ ID NO: 340135 - DNA, 713 bp, Homo sapiens
  misc_feature: GZ8MTXP02HLEGX.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtataggtaaattgggtgcgacgacggcccccggagaagggtctggagggtggggtggggtgggtcgaggtcggtcgtttggacggtaaggcaacgagtagtgacccgaaccgaagagtaggaaaggggcaagggtacgtaccgaaacgtaacgttaaacccccgaacgggaacccccaaaccccccgaacggaaaccaaccgacggtacctaacaagtacgacctaaacgtcggaacgaacgtcccgtaggaacgacggtacgtacggaacgaccggaaccgggacccgttaccgttacttacgttacgtcggtacgtaacgtaagttaacgttttcgttacgttacgttaactacgtttaaaccgttaaacgtttacgttaagtaagttaaccggttacttaacggttacggtacggtttacggttacggtttaccggtttaccggggg

SEQ ID NO: 340136 - DNA, 588 bp, Homo sapiens
  misc_feature: GZ8MTXP02IOEGI.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacacgggcccccggagaaggcttggaggtggggtggggtggggtcgaggcggcgttttaggacgggtaagcacgagtatggaccaaccggaagataggaaggggacaggacgtcaacgtactacccgaaccgggaccacccccaagaaccacagtactacactgacaacgtcgaacgacgcctagagacgctagacgacgacggacctcgtattactgcgacgagtaattcgttttcagttacgtacttacggttaacttaagtttgaagttgtcttagtacgttggaccgttggtacctttcggacggggg

SEQ ID NO: 340137 - DNA, 580 bp, Homo sapiens
  misc_feature: GZ8MTXP02H4V9X.17.10.A10.1.454.CMB.2.raw
  modified_base (397)..(397): a, c, t, g, unknown or other
  misc_feature (397)..(397): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatagaaattgggtgcgacgacggcccccggaagaacgggcttaggagggttggggtggggtggggtcgaggcggtcgttttggaacgggttaaggcgaacgaggtaatgaccgaccgaaagataggaaggcaagngtacacgattaccgacggaccacccccagaacacagtactacatcgacaactgaacgacgcctagaacgagactgaacgacgaccgggcccttagtactactgcgacgagtaattgtttactgtacattaccgtataattcgataggtctactagtcggtaactcggtacgtttacgacgggg

SEQ ID NO: 340138 - DNA, 570 bp, Homo sapiens
  misc_feature: GZ8MTXP02IBGKS.17.10.A10.1.454.CMB.2.raw
  modified_base (374)..(374): a, c, t, g, unknown or other
  misc_feature (374)..(374): n is a, c, g, or t
  modified_base (487)..(487): a, c, t, g, unknown or other
  misc_feature (487)..(487): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgagaagggcttgaggtggggtggggtgggtcgaggcggtcgtttggacggtaaggcaacgagtatgcccaacgaagataggaaggcagngtcaacgtacttaacccgacgggacccacccccaaagaacacacgtacacatcgacaactgaacgtagccgttagacgagcgtacgaccgacgaccgggaccgtctattacgnggtacgcgtagtaattgtttcagttcattaccgtattacgttgaataggtcttactagtcggactcggtacttcggtacgggg

SEQ ID NO: 340139 - DNA, 617 bp, Homo sapiens
  misc_feature: GZ8MTXP02H0NKE.17.10.A10.1.454.CMB.2.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttcacaaaatatggtatgaattgggtgcgacacggcccccgganaagggctttggaggtggggtggggtggtcgaggcggtctttggacggttaaggcacgagtatgccaccgaagagtaggaagggcaggcgtcaacgacttaccgaacggaccacccccacgaaacacctagtctacactgacaactgacgagacctagaggacacgtcgaacgaccgaacgggtcccgttctaacgttaccgtggtagaccggtaagtaaagtttcgttttgtacgttctaacgtaccggttaaactagttttacgaagttacgggtccctttacgtaaagttcgggtaacgttcgggtaacgtttccgggtaccggggg

SEQ ID NO: 340140 - DNA, 644 bp, Homo sapiens
  misc_feature: GZ8MTXP02GNJCD.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctgccggcccccggacaggaggtcaccatctcttgctctacggaaccccccatgtgattcaattatgtgtcctggtaccagcaactcccggatcacgcccccaaactcctacatatatagaaagataaataacgaccgaccctcgtacggggttcccctagaccgtattctcgtcggctccgtaagtctcggcacgtctcgcccacccgtggcatccgaccgcgtctccagacgtggggacgacggacccgtaagttacttttccgaggccgaccgaaacgtcgtacggggtaacctttacccgaacggtcccttaggtaaccgtttccgggttgggggtttcgtttccgggacgtaacgggttaccggggaaccctaaacggggtccttacgggaaccccgttaccggtaacggttacccgaccggaccccgtaacggtcccttcccccggg

SEQ ID NO: 340141 - DNA, 598 bp, Homo sapiens
  misc_feature: GZ8MTXP02GRT4T.17.10.A10.1.454.CMB.2.raw
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacacaaaatatggtatgaattgggtgcgacaggcccccganaaggctgaggtgggtggggtggtcaggcggtcgtttggacggtaagcacagtatgcaccgaagagtgaagggcaagngtacaacgattacccgacggaaccacccccgaaacgaaacacaagtctaacatagacaacctggaacgagcctagagagctacgacgaccgaccggccgtactattacgngtagacgaagtacgttgttttctgttactacgttcgttaaactaagttttacgaatttaacgggccctttacgttaagttacgggtaaccgttgggtaacccgttttcgggtaacccggggg

SEQ ID NO: 340142 - DNA, 593 bp, Homo sapiens
  misc_feature: GZ8MTXP02FK69V.17.10.A10.1.454.CMB.2.raw
  modified_base (258)..(258): a, c, t, g, unknown or other
  misc_feature (258)..(258): n is a, c, g, or t
  modified_base (458)..(458): a, c, t, g, unknown or other
  misc_feature (458)..(458): n is a, c, g, or t
tcagcgtagactagcacgaccggtgctcgatttagcgtcgatctcaggggagctctgcttcagctgtgagcgcagaaggcaggactcgggacaatcttcatcatgaccctgctcccctctcctcctcaccccttctcattcactgcacagggtcctgggcccagtctgtgttgacacagccgccctcagtgtctgccggcccccggacaggaggtcaccatctcttgctctcggaaaccccccatgtgattcaattangtgtcctggtaccagcaactcccggatccacgcccccaaactcctcatactatagaagataagtaacgccgaccctacgaggggttccccctagaccgattctctcggctccgaagtctgggacctacgtctcgcccacccgtcgggccactccgacccgccgcctcccgagcgtggggaccgaggccgtagtatttcgngtacgacaacgagtgggtacttcccgagtccgtagtaccgttcggtggggttcgttcggcgtacggtcgggaaccgaacggcgttacggaacccgttccgtacggtacaccggtcccgaacggtccctaccccgg

SEQ ID NO: 340143 - DNA, 649 bp, Homo sapiens
  misc_feature: GZ8MTXP02G527Q.17.10.A10.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (397)..(397): a, c, t, g, unknown or other
  misc_feature (397)..(397): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttnacaaaatntggtatgaattgggtgcgacacggcccccgganaagggcttggaggtggggtggggtggtcgaggcgggtcgtttagggaacgggttaagggcctaaacgaggtagtgacccgaaccgaagagtagggaagggcaaggngtacacgtactacccgacggaccaacccccgagaaaccacacgtcaacactaggaccaacgtcgaacgtacgcccgtaggaagacgtcgacggaaccgacgacccggggtcctacgtaacgttaccgtagtcggaccgtaagtaacgttttggtttttaccacggttactaacgttaccgtaaacttaaagttttcgaacgtttaacggctttacgtagttacggtaacttcgggttacttcggtacggggg

SEQ ID NO: 340144 - DNA, 529 bp, Homo sapiens
  misc_feature: GZ8MTXP02I5OR3.17.10.A10.1.454.CMB.2.raw
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggccccggacaggaggtcaccatctcttgctctcggaaaccccccaatcgttggattcaattatgtgtcctggtaccagcaacgtcccggatccacgccccaaactcctcatatactgaagataataacgacgaccctcgaggggttcccctgacctacgttctctcggctccgaaagtcgtcggcacgtctcgcccacccgtgggcactccgaccgcgctccagactggggacaggccgagttattcgngcacaacagnggactcagcctgactcgtgggtntggctaggtcggaccagtctacgaaccgtctaggtcagccctaggctcccg

SEQ ID NO: 340145 - DNA, 534 bp, Homo sapiens
  misc_feature: GZ8MTXP02IDI4B.17.10.A10.1.454.CMB.2.raw
  modified_base (374)..(374): a, c, t, g, unknown or other
  misc_feature (374)..(374): n is a, c, g, or t
  modified_base (440)..(440): a, c, t, g, unknown or other
  misc_feature (440)..(440): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccggacaagggcttgaggtggggtggggtggggtcgaggcggctttggacgggtaaggcacgagtatgccaccgaagatggaaagggcagngtcacgattaccacggaccaccccacgaaccacagtctacatgcaactgacgagcctagagagtcngacgacacggccgtactattactgtgcgagtaattgtttctgtcatcgtaactaattcgataggcttactagtcggactggtacgttcgcgggg

SEQ ID NO: 340146 - DNA, 517 bp, Homo sapiens
  misc_feature: GZ8MTXP02GABZG.17.10.A10.1.454.CMB.2.raw
  modified_base (377)..(377): a, c, t, g, unknown or other
  misc_feature (377)..(377): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaaatatggtatgaaattggggtgcgacaggccccccggacaagggctttgaggtggggtgggggtggggtcgaggcggcgtttgacgggtaaggcacagtaatgccaccgaagatgaagggcagngtcacgattaccacggacacccccacgaacacagtctacatgcaacctgacgagcctgagagcgtgacgacacggccgtctattactgtgcagatgtttctgtcatcgtanattganagctatatgactgacttcggngg

SEQ ID NO: 340147 - DNA, 707 bp, Homo sapiens
  misc_feature: GZ8MTXP02H048T.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaagccagtgatatatcttacaacaaaatatggtaatgtaagttgggtgcgacgacggcccccggagaagggcgttaggaggttggggtggggtgggtcgaggtcggtacgtttggacgggtaaggcgaacgtagtagtacgtaacccgaagagtggaaggggcaggagtcgacgtaattaccccgaaccgggaacccaacccccccgaagaaacccacgtaacgtaccctaacgtagtcgaacctaaacgtacggaaccgaacgtcccgtagaaacggacgtaccgtacggaaaccggaacccgtaacccgggtcccggttaacttaaacgtttacccgtaggtttacggacgtaaaggttagtttacgttttttcccgagttaccgtacgtttaaccgttaacttaaaagttttcgagtttacggctttaacgtagttacggtacgttacggttaccgttcggtacgggggacccggg

SEQ ID NO: 340148 - DNA, 539 bp, Homo sapiens
  misc_feature: GZ8MTXP02H3WLL.17.10.A10.1.454.CMB.2.raw
  modified_base (287)..(287): a, c, t, g, unknown or other
  misc_feature (287)..(287): n is a, c, g, or t
  modified_base (365)..(365): a, c, t, g, unknown or other
  misc_feature (365)..(365): n is a, c, g, or t
  modified_base (480)..(480): a, c, t, g, unknown or other
  misc_feature (480)..(480): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccganaagggctgaggtgggtggggtgggtcaggcggtctttggacggtaggcacgagtatgccacgaagatggaagggcagngtcaacgattaccacggaccacccccacgaacacagctacatgacaactgaacgagcctgagagcctaggacgacgacggccgtactacttatggtagcgaagtaagttgtttcngttaccatccgttaactatttagataggtctctaagtggaccgtgtacttcgtcggggg

SEQ ID NO: 340149 - DNA, 666 bp, Homo sapiens
  misc_feature: GZ8MTXP02GZZOP.17.10.A10.1.454.CMB.2.raw
  modified_base (402)..(402): a, c, t, g, unknown or other
  misc_feature (402)..(402): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatgaagttgggtgcgacgaccggccccggacgaagggtcttaggagggttggggtggggtgggtacgaggtcggtcgtttaggacgggttaaggcgacgtagtatcgaccgaaccgaagagtagggaacggcgaagngtacacggaacgttaacccgaaccggaacccaacccccgaaacgaaacacgtaacgtactaacgatacgtacaacgtacgaacgacgtccgagagagcacgacgacgaccgggtctacgttacgttacgtgtacgacgtagtaattcgttttcgtacgttacgttaacgttaccgttaaacgtttacgtttacgtaagttacggtaaccgtttacttagttacgggtacgtttacggttaccggtttacgggttaacccggggg

SEQ ID NO: 340150 - DNA, 682 bp, Homo sapiens
  misc_feature: GZ8MTXP02GCFHD.17.10.A10.1.454.CMB.2.raw
  modified_base (517)..(517): a, c, t, g, unknown or other
  misc_feature (517)..(517): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtgatatatcttcaacaaaatatggtatgaattgggtgcgacacggcccccggacgaagggcttggaggtggggtggggtgggtcgaggtcggtctttggacggttaaaggcacgtagtagtgacccgacgaagagtaggaagggcgagcgtacaacggacttaccgaccggaaccaacccccacgaaacacgtagtacctacatcgacaactcgaacgacgacccgtaggaacgacgcgtacggaccgaccgaaccggtccggttaccttagtttaccgnggttacgaccggtagtaaacgtttcggtttttacctgggtttaccctaagtttaccggttaaactttaaacgttttaacggtagtttaaacgggtcccgttaacgtttaacggtacgggggtttaacccgttagggttaaccgtttttccgggtaacccgggggg

SEQ ID NO: 340151 - DNA, 642 bp, Homo sapiens
  misc_feature: GZ8MTXP02JPFXW.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatatggtatgaattgggtgcgacgacggcccccggagaagggcttggaggtggggtggggtgggtcgaggtcggtcgtttggacggtaaggcaacgagtatgaccaccggaagagtaggaagggcagagtcaacgtacttaacccgaccgggaacccaacccccgacgaaaccacaacggtacctacatcgacaacgtgaacgacgacccgtagaagacgcgtacggaaccgaccgaccgggtaccgtacgtaacgtttacgtcggtcggacggtaacgtaaagtttcgtttttacgtggttactacgttaccgttaaacgtacgtttacggaattacgggtcttacgtaagttacggtacgttacggttacgttcggtaccggggg

SEQ ID NO: 340152 - DNA, 559 bp, Homo sapiens
  misc_feature: GZ8MTXP02G39V2.17.10.A10.1.454.CMB.2.raw
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (471)..(471): a, c, t, g, unknown or other
  misc_feature (471)..(471): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaaatatggtatgaaattgggtgcgacacggcccccgganaagggcttggaggtggggtggggtggtcaggcggntttggacggtaaggctacagtatgaccacgaagangaagggcagngtcaacgataccacgacacccccagaacacagtactaacatgacaaacngaacgaagtcccngagagcagacgacgaccgggtcctactaactttagngtacgagtagtattgtttcttgtactactacgtaactaacttagtagtacgtaacgtacgtagtacggtacgtcgtacgttcgtcggg

SEQ ID NO: 340153 - DNA, 650 bp, Homo sapiens
  misc_feature: GZ8MTXP02HAVJ9.17.10.A10.1.454.CMB.2.raw
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgtaattgggtgacgacgacggcccccgganaagggcttggagggttggggtggggtgggtcgaggtcgggtcgttttgggacgggttaaggccaacgtaggtatggacccgaaccgaagagtaggaaggcaagngtcacgtataccacggaccacccccgagaaccacacgtctaacatcgacaacgtgaacgacgcctagagacgacgtacgaccgaccgaccggggtcctacttaagttaccgtggttcgaccgtaaaggtaatttcggtttttacctaggttacctaagttaccggttaaacttaaacgtttttacgaacgtttagggtaacctttacgtaaggtttacggacgtttacgggtaccgttttacggaccgggggg

SEQ ID NO: 340154 - DNA, 592 bp, Homo sapiens
  misc_feature: GZ8MTXP02GPMFI.17.10.A10.1.454.CMB.2.raw
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
tcagcgtagactagcacgaccggtgctcgatttagcgtcgatctcaggggagctctgcttcagctgtgagcgcagaaggcaggactcgggacaatcttcatcatgacctgctccctctcctcctcaccttctcattcactgcacaggtcctgggcccagtctgtgttgacacagccgccctcagtgtctgcggccccggacaggaggtcaccatctcttgctctcggaaaccccccaatcgttggattcaattatgtgtcctggtaccagcaactcccgggatccacgacccccaaactccctacatatactagaaagataaataaagcgaaccctcgaggggttcccctagaccgaattcctctggctcccaaagtctggcacgtctcgcccaccgtggcatccaccgnacctccagacgtggggacaggcccgtaagtacttttccggngaccgacaaacgtacgtcggtaccttccgacgtcccgtagtacgttcgggtcggggttcgttacggacgtacgggtacggaacctaagtccgtacggaacccgttcgtaacggtaccaccgtacccgaacggtccctcccg

SEQ ID NO: 340155 - DNA, 518 bp, Homo sapiens
  misc_feature: GZ8MTXP02IK1AE.17.10.A10.1.454.CMB.2.raw
  modified_base (363)..(363): a, c, t, g, unknown or other
  misc_feature (363)..(363): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgccaccgaagatgaagggcagngtcacgattaccacggacacccccagaaacacagtctacatgcaaactgaacgagccctgagagctagacgacacgggccgtactatactgtgcgaagatgtttcngtcatcgtactaatttnattaggctntatggactggacttcgtacgggg

SEQ ID NO: 340156 - DNA, 749 bp, Homo sapiens
  misc_feature: GZ8MTXP02IOAF5.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaacaaaatatggtatgaagttgggtgacgacacggcccccggagaacgggcttggaggtggggtggggtgggtcgaggcggtcgtttggacgggtaaggcacgagtatgacccgaaccgaaagagtaggaaggggacgaagtaggtacaacggtaacgttaacccgaaccgggaacccaaacccccccgaaacggaaaacccaaccgaaacggttacctaaacgaacgttacgacctaaacgacgaccgaacgtacccgtaggaagacggacgtacggaccgaaccgtaccgggaccgttacgttaacgtttaccgtaggttacggaccggtaagttaaaagtttcggtttttaccgtacgggtttacctaaacgtttcccggtttaaaacttaacgtttttaaggttaacggttaaacgggttccgtttaaccgtttaaggttacgggttaaaccgtttccggggtttaaaccggtttccgggttaaacccggggggg

SEQ ID NO: 340157 - DNA, 603 bp, Homo sapiens
  misc_feature: GZ8MTXP02GKUH6.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacaacaaaatatggtatgaagttgggtgcgacgacggcccccggacgaagggcttggagggttggggtggggtgggtcgaggtcggtcgtttggacggtaggccagaggtatgacccgaccggaagacgtaggaagggcaaggagtcgaacgtactacccgaccggaccaccccgaacgaacacagtctacatcgacaactgaacgtacgctagacgacgcgtcgacgacgaccggtccgtacttagttacgtgtgacgtagtaagtttcgtttctggttactattaccgtattaacgttagaagttcggtaactacgttagtacggttagacggttcgtttacggggaccgggg

SEQ ID NO: 340158 - DNA, 594 bp, Homo sapiens
  misc_feature: GZ8MTXP02HHPPY.17.10.A10.1.454.CMB.2.raw
  modified_base (289)..(289): a, c, t, g, unknown or other
  misc_feature (289)..(289): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtgcgacacggccccganaagggctggaggtggggtggggtggtcaggcggtctttggacggtagcanagtngcacgaagnagaaggcagngtcagactaccacgacccaccccaacgaacacagtactacatgactacgacgaacgacgccagaacgacgacgtacggaccgaacgaccggggtcctacttacgttaaccgtggtacgaccggaagttaaagtttcgttttacgtcggttacacgttacccggttaaacttaacgtttgaacgttacggtcctacgttagttacggaactcggtacgtttcggacccggggg

SEQ ID NO: 340159 - DNA, 690 bp, Homo sapiens
  misc_feature: GZ8MTXP02HFRJ9.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaactaaaatgtaggtatagtaagttgggtgcgacgacggcccccggaagaagggcttggagggttggggtggggtgggtcgaggtcggtcgtttgggacgggttaaggcaacgtagtagtcgcccgaaccggaagagtaggaagggcaaggcgtaccgaacgtacgttaacccgaccgggaacccaacccccgaagaaaccacgtacgttacaacgacgtacgacctaaacgacggaacgacgtccgtaggacgaacgccgacggaaccgaccggaccgggtcccgttacgttaaacgttccgtaggttcggaccgtaagttaacgtttcgtttttacgacggttacttacgttaccggttaacttaacgtttagaacgttacgtaaccgttagttaccggtaggtacgttacgggtaccgtttcggggtaaccggggg

SEQ ID NO: 340160 - DNA, 662 bp, Homo sapiens
  misc_feature: GZ8MTXP02H84Y2.17.10.A10.1.454.CMB.2.raw
  modified_base (447)..(447): a, c, t, g, unknown or other
  misc_feature (447)..(447): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacaacaaaatatggtatagaattgggtgcgacgacggacccccggacgaagggcttggagggttggggtggggtggggtacgaggcggtacgtttggacgggtaaggcacgagtatgccaaccgaagatacggaagggacaggagtacgaacgacttaaccgaaccggacccaaacccccgacaaaccacacgtacactancgaccaacgtgaacgagacctaggacgacgactacggaaccgacgtaccgggccgttactaagttaccgtaggtacggtaccgtaagtaaagtttcggtttttacgtacggttctaacgttacccggttaaacttaaacgtttacggtagttaacgggtcctttaacgtaacgttagggtaaacgttcgggtaaacgttttccgggaaccggggg

SEQ ID NO: 340161 - DNA, 680 bp, Homo sapiens
  misc_feature: GZ8MTXP02GD3M6.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaagttgggtgcgacgacggcccccggaagaagggtcttggagggttggggtgggggtgggtcgaggtcggtcgttttgggacgggttaaggcacgtaagtagtcggacccaaccggaaagagtagggaaaggggccaaggtacggtaccgaacggtaacttaacccgaaccgggaacccaaccccccgaaagaaaccacaacgtacctaacattcgacaactggaaccgagaccgtaggaacggacgcgtacggaaccgaccggaccgggtaccgtacttaacttacgtgtacgacggtaagtaagtttcgttttacgtgttactaacgttacggttaaacttaaacgttttacggaagttacggtaacttacgttaagtacggtacgttcgggtaaccgtttcggtaccggggg

SEQ ID NO: 340162 - DNA, 574 bp, Homo sapiens
  misc_feature: GZ8MTXP02HHJXM.17.10.A10.1.454.CMB.2.raw
  modified_base (291)..(291): a, c, t, g, unknown or other
  misc_feature (291)..(291): n is a, c, g, or t
  modified_base (374)..(374): a, c, t, g, unknown or other
  misc_feature (374)..(374): n is a, c, g, or t
  modified_base (471)..(471): a, c, t, g, unknown or other
  misc_feature (471)..(471): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcacaaaatatggtatgaattgggtgcgacaggccccccgganaagggcttgagtgggtggggtgggtcaggcggctttggacgggtaaggcacgagtagtgccaccgaagataggaagggcaagngtcacgattacccacgggaccacccccgaacgaaaccacagtacctacatcgacaactgaacgagcctagagagctgacgacacggcctctattacngtgacgagtaattcggttttctcggttctacgtacggttaactaacgtttcgaagtaaggtcttcgttaagtggtaaccttgggaccttttacggtccggggg

SEQ ID NO: 340163 - DNA, 603 bp, Homo sapiens
  misc_feature: GZ8MTXP02GTK5Y.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatgaattgggtgacgacgacggacccccggagaagggcttaggaggtggggtggggtggtcgaggcggtctttggacggtaaggcacgagtagtgaccgaccgaagagtaggaaggcagagtcacgacttaccgaaccgggaccacccccgaacgaaacacgtagtacacatcgacaacgtagacgagaccctaggagacgacgtacgaaccgacaccgggccgtacgttagtaacgtgacgtcgaagtaattgttttactggttactacgtaccgtactaagtttcgagtttacggcttacgtagtacggacgttacggtacgtttcggaccggggg

SEQ ID NO: 340164 - DNA, 581 bp, Homo sapiens
  misc_feature: GZ8MTXP02HFV8J.17.10.A10.1.454.CMB.2.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (376)..(376): a, c, t, g, unknown or other
  misc_feature (376)..(376): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacacaaaatatggtatgaattgggtncganacggcccccgganaagggcttgaggtggggtggggtgggtcgaggcggtgtttggacgggtaaggcacgagtatgaccacgaagatggaagggcagngtcacgataccacgggaccacccccacgaacacagtacacatcacaactgaacgngtaccngagngtcagacgcgaccggccgtactacttacgtcggtagacgagtaacttcgttttactggttctacgtaccgttaatacgtttacgattacggaaccttacgttagtcggtaacgttcggtaccgtttacggtaccgggggg

SEQ ID NO: 340165 - DNA, 517 bp, Homo sapiens
  misc_feature: GZ8MTXP02F2L0R.17.10.A10.1.454.CMB.2.raw
  modified_base (365)..(365): a, c, t, g, unknown or other
  misc_feature (365)..(365): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggcagtggatatatcttcacaaaatatggtatgaattgggtgcgacaggcccccggacaagggcttgagtggggtggggtggggtcgagcggctttgacggtaaggcacagtatgccaccgaagatgaagggcagngtcacgattaccacggacacccccacaaacacagtctacatgcaactgacgagcctgagagctgacgacacgggccgtctattactgtgcgagaatgtttctgtcatcgtactaatttgaataggctcgtatggactggtactcgtcggggg

SEQ ID NO: 340166 - DNA, 635 bp, Homo sapiens
  misc_feature: GZ8MTXP02H881X.17.10.A10.1.454.CMB.2.raw
  modified_base (255)..(255): a, c, t, g, unknown or other
  misc_feature (255)..(255): n is a, c, g, or t
  modified_base (375)..(375): a, c, t, g, unknown or other
  misc_feature (375)..(375): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatctacacaaaatntggtatgaattgggtgcgacacgggcccccggagaagggcttggaggtggggtgggtgggtcaggcggtctttggacggtaggcagagtatgacctaccggaagagtagggaaggcaagngtacaacggacgttaacccgaccgggacccaacccccgaacgaacctacgacgtactacagtacgacaactggaacgacgaccgtagacggagtaccgtaggaaccgaccgaccgggtacccgtcgttaattacgttggcgtacggaagttaagtttcgttttcgtacgtttacgtacgttaacccggttacttaagtttacggtaacttacgggtcttcgtaaggtcggtaacgttcggtacgtttcgggacccggggg

SEQ ID NO: 340167 - DNA, 658 bp, Homo sapiens
  misc_feature: GZ8MTXP02JATTN.17.10.A10.1.454.CMB.2.raw
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacatgtgcccagcccaggttcagttggtgcagactggggctgaggtgcagagcctggggcatcagtgactgtctctgcaaggccagtgatatatctnacaaatntggtatgaattgggngcgtacaggcccccganaagggcttggagtggtggggtggtcaggtcggctttaggacggttaaggctacgagtacgtcgacgaccgaaagngttagaacgggtccaggtacgttacgaacggtaacttacccgaacgggtaccaaccccccgtaaagaaacctaaccgagtacgtaccgaagtacgacctaaacgttcggaaccgtacggtaccccttaggaaccgtaacggtccgttaaggaccgtaaccgtaccggtacccgtacttaacgttaccgtgggtacggtacgtaacgtaaacgtttcggttttcgtaggtcctaaaggttcccgttaataacgttttcgaagttaacggtctacgttagtcggtaactggtacgtttaccggg

SEQ ID NO: 340168 - DNA, 654 bp, Homo sapiens
  misc_feature: GZ8MTXP02ILXU5.17.10.A10.1.454.CMB.2.raw
  modified_base (259)..(259): a, c, t, g, unknown or other
  misc_feature (259)..(259): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcaggaggcacaggtgcccacgcccaggttcagttggtgcagactggggctgaggtgcagaagcctggggcatcagtgactgtctcctgcaaggccagtggatatatcttacaactaaaatntggtatgaagttgggtgcgacacggcccccggagaagggcttggagtggggtggggtggtcgaggcggtctttggacgggtaggcacgagtatcgcaaccccggaagagtaggaagggcgtaaggacgtcgaacgtaacgttaaccccgaaccgggaacccaacccccccgaaacggaaacccactaaacggtcctaaacgacgtcgaccaaacgtcggaacgaacgcccgtaggacgaagtcctaggaaccgacgacccgggtccggttacttaacgttaccgtggttacgacggtaaagtagttttcgttttctggtactaatccggttaaatagttttacgagttacggtcctgttaagtggtactacggttcttccgggtaggggacccgg

SEQ ID NO: 340169 - DNA, 661 bp, Homo sapiens
  misc_feature: GZ8MTXP02HAHXK.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtggggcatcagtgactgtctcctgcaggccagtgatatatcttacaacaaaatatggtatgtaaagttggggtgcgacacgtcggaccccccgggaagaaaggggctttgggaggtgggggtggggtgggtcgaggtcggtcgtttgggaacggtaaggcacgaggttatcggaccaaccggaagagtaggaagggcaggacgtcaacgtataacccgaacgggacccacccccaacgaaccacgagtctaacatcgacaacgtcggaacgcgtaccgtagacgagacgtagaccgtacgaaccggtccgtaccttagttacgtcggtagaccggtaagttaacgtttcggttttacctcggttacttaaacgttccgttaaaacgttaactttgggaaattccggggttacttacgttaggtcgggttaaccgttcggggtaaccgttttcccggggg

SEQ ID NO: 340170 - DNA, 697 bp, Homo sapiens
  misc_feature: GZ8MTXP02JG5CX.17.10.A10.1.454.CMB.2.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (512)..(512): a, c, t, g, unknown or other
  misc_feature (512)..(512): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggtttcagttggtgcagacgtggggctgaggtgcagagccgtggggcatcagtgactgtctcctgcaaggccagtgatatatcttanaacaaaatntggtatgaagttgggncgaacgacggacccccggaanaaggggtctttggacgggttgggggtaggggtggttaccgaggtcgggtcgttttaggggaacggttaaaggccgaacgtaggtaacgtcggaaccccgaaccggaaagtacgtagggaaacggcgaagacggttaccaaacggtacttaaccccgaaccgggacccaaccccccgaagaacccacgtacgttcaacagtcgacaacgtcgaacgngaccgagacgagaccgaggaccgaccggacgggtcccttagttacgttacgtggtacgtacggtaaagttacgtttgttttacgtcgttactacggttacttaaaccgttagttttacgacgtttagggtaaccctttagtaacggtcggtacgtttaacgggtccgtttacggggacccggggg

SEQ ID NO: 340171 - DNA, 603 bp, Homo sapiens
  misc_feature: GZ8MTXP02HHN68.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctcctgcaaggccagtggatatatcttacaacaaaatatggtatgaattgggtgcgacacggcccccgagaagggcttggaggtggggtggggtgggtcaggcgggtcgtttgggacggtaagcgacgaggtatgaccgaacgaagagtaggaaagggcaaggacgtcaacgtaactacccgaaccggacccaacccccgagaaccacacgtactacgatgactacgtagaacgagaccgtagacgacgtacgcgacgaccgacggtaccgtacttagttacgtggtcgacgaagttaagttcgttttcagttactagttcgtaaacttactttagagttacggcttcgtaagtcgggaacttcggtaactttcggcggggg

SEQ ID NO: 340172 - DNA, 585 bp, Homo sapiens
  misc_feature: GZ8MTXP02FZO8L.17.10.A10.1.454.CMB.2.raw
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggaggtcaccatctcttgctctcggaaaccccccaatgttggattcaattatgtgtcctggtaccagcaacgtcccggatcacgcccccaaactcctcactatatagaaagataataacgccgaccctacgtacggggttcccctcgaccgtattctctcggctccaagtctggccacgtctcgcccacccgtgggccatccaccgcgctccagacgtgggacgtaggcccgtagttactttcgngcgacaaccgngtcggggtacttccgacgtccctagtaccgttcgtgggggttcgtacggcgtaaggtcggggaaccaaggtccgtacgaaccggttcccgtaggtaccacgacccgaacggtcctaccccgg

SEQ ID NO: 340173 - DNA, 610 bp, Homo sapiens
  misc_feature: GZ8MTXP02GOK9X.17.10.A10.1.454.CMB.2.raw
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
  modified_base (519)..(519): a, c, t, g, unknown or other
  misc_feature (519)..(519): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggccccccgganaaggggcttggagggtggggtgggggtgggtcgaggtcgggtcgtttagggacgggtaaggctaacgagtatggacccaaccgaagataggaagggcaaggngtcaacgtacttaacccgaacggacccaaccccccgaacgaaacaccaacgtctaacatcgacaaacctgaacgacgccctagaagagcgtaggaaccgacgaccgggccgtaccttaattaccgngtacgacggaagtaattggttttactcgttactagtcgttaaactactttagataggcttctagtcggactcggtacgtttcggtacgggg

SEQ ID NO: 340174 - DNA, 697 bp, Homo sapiens
  misc_feature: GZ8MTXP02GDG65.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaggccagtgatatatcttacaactaaatgtaggtatagtaagttgggtcgacgacgaccggcccccggaagaagggtcttggagggttcggggtggggtggtcgaggtcgggtgtttagggaacggttaggacagtagtagtcggacccaacgggaagtacgtaggggaacgggcgaagggacgtaaccgaacggtaaactaaccccgacccggaaaccccaaacccccgaacgaaaccacgtacgtactaacgagtcgaactacgtacgaacgtcgaccgtaggaacgtacgcgtacggaaccgaccggaccggttacgtactttaaacgtttcgtaggtacgtaaccggtaagtttaacgttttcgtttacgacgtttacgtaacgtttacgtaaacgtttagtttacgacgtttacggctttacgtaaggtcggtaacgttcggttaacggttcggtaaccgggg

SEQ ID NO: 340175 - DNA, 761 bp, Homo sapiens
  misc_feature: GZ8MTXP02IPPBL.17.10.A10.1.454.CMB.2.raw
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtgggctggaggtgcagaagccgtgggcatcagtgactgtctcctgcaggcagtgatatatcttcaacaaatntggtatgaagttgggtgacgacgacgggacccccggacgaagggtcgttaggagggtggggtgggggtgggtcgaggcgggtcgtttagggacggtaaggcacgagtagtcgacccgaaccggtaaagagtaagggaagggacgaaggtacggttacaaaccggtaacgttaaccccgaaacccggggaaccccaaacccccccgaacgaaaacccgaccgtaaacggttaccctaaacctaagttaccggaaccctaaaacgttcggaaacccggaacgtacccgtaaggaaacggacggtaccgtaacgggaaccggaacccgtaccggggacccgttaacttaacgtttaaccgtggttacggaacgtaaggttaaagtttcggtttttacctggtttacctaactttaaccggtttaaactaaggttttacgtaacgttaacgggtccttaacgtaaggttcgggtaaacgttcgggtaaaccgttttcggggaaccggggg

SEQ ID NO: 340176 - DNA, 709 bp, Homo sapiens
  misc_feature: GZ8MTXP02IKYY8.17.10.A10.1.454.CMB.2.raw
  modified_base (379)..(379): a, c, t, g, unknown or other
  misc_feature (379)..(379): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccagggttcagttggtgcagacgtggggctggaggtgcagaagccgtggggcatcagtgactgtctcctgcaaggccagtggattatatcttacaacaaaatatggtataggtaattgggtgacgacgacgggacccccggagaaggcgttggagggttggggtggggtgggtcgaggtcgggtcgttttagggacgggtaaggcgaacgtaagtacgnggaccccgaaccggaaagagtaggggaaggcgaaggtacggtacgaaacgtaacgttaaaccccgaacccgggaaccccaaacccccgaaaccggaacaaaccgacgtactaaccgatacgacaacgtacgaacggaacgccaggacgacgacgtacggaaccgaccgtacccgggtaccgttacgtaacgtttacgtcgtacggacgtaagttaacgtttcgtttttcgtacgttacgtaacgtttacgttaaacgttaacgtttacgtaagttacggtaacttacgtaacgttgggtaacgtcgggttacgtttacgggtaccggggg

SEQ ID NO: 340177 - DNA, 632 bp, Homo sapiens
  misc_feature: GZ8MTXP02GEH36.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatagaattgggtgcgacacggcccccggagaagggctggaggtggggtggggtaggtcgaggcggtctttggacggttaaggcacgagtatcgaccgaccgagagtggaagggcaggagtcaacgagttaccacggaaccacccccgagaaaccacgagtctaacatcgacaacgtgaccgagcctagagacgctaggaaccgcgaaccggggtcctaccgttaagttacgtcggtgaccggtaagtaactttgggttttacctggttacctacgtttaccggttacttaagtttacggaagttacgggaactttaaccgttagttacggggtaccgtttacggggtaacccgttttcgggtaaccggggg

SEQ ID NO: 340178 - DNA, 704 bp, Homo sapiens
  misc_feature: GZ8MTXP02F8SL9.17.10.A10.1.454.CMB.2.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccgganaagggcttggaggtggggtggggtgggtcaggcggtctttaggacggtaaggcacgagtatggaccaaccgaagagtaggaaaggggcaagggacgtcgaaacgtaacgttaacccgaaccgggaacccaaaccccccgaagaaaaccacgaacgtacctaacatgaccaacgtaggaaccgaacgcccgtagaaaggaccgacgttacggaacccgacgaacccgggtcccgtaccttaagttaccgtgggtacgaccggtaagtaaacgtttcggtttttacgtacggtttacctaacgtttaccgttaaaccgttaaagtttttaacggagtttaaaccggggtctttaacccgttaagtttaccggggtaaccgtttacgggtaaccgtttttccggggtaccgggggg

SEQ ID NO: 340179 - DNA, 526 bp, Homo sapiens
  misc_feature: GZ8MTXP02FU5I8.17.10.A10.1.454.CMB.2.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcaacaggtgcccacgcccaggttcagttggtgcagactgggggctgaggtgcagaagcctggggcatcagtgactgtctcctgcaaggccagtggatatatcttnacaaaatatggtatgaattggggtgcgacaggccccccgganaagggcttgagtgggtggggtgggtcagcggctttgacggtaaggcacagtatgccaccgaagactgaaggggcagngcacgattaccacggacacccccagaaccacagtctacatgcaaactgacgagcctgagagctgacgacacgggcgtcctattactgtgcgagtaatgtttctgtcatcgtacaatttgattacggctctaatggacttggaacttcgtacggggg

SEQ ID NO: 340180 - DNA, 754 bp, Homo sapiens
  misc_feature: GZ8MTXP02GRA5H.17.10.A10.1.454.CMB.2.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtgggcatcagtgactgtctctgcaagcagtgatatatctacaataaatntgtatgtagttgggcncgacgaccggaccccgagaaggtctaggagggtggggtggggtcggtcgaggtcgggttgtttacggggaacgggttaacggcctaaagtaaggtacgtacggaccccgaaacggaaaggtagtaacggggaaggggacaaggtacggtaccaaacggtaaaccttaacccgaacccgggaaacccccaacccccgtaaacgaaaccacggtacgttaccaacgacgttacgacctaaccgtaggaaccgtacggacccgtaggacgacgttaccggtaacggaacccggtaccgtacccggggtaccctttacgttaaacgtttaccgtggtaaccggtacgggtaaacttttagtttcgtttttaacggtacttacggttactttaaccggtaacgttttaacgtttacggaagtttacgggtaacctttagttaaggttacggtacgttacgggttccggtttacggggtaacccggggg

SEQ ID NO: 340181 - DNA, 557 bp, Homo sapiens
  misc_feature: GZ8MTXP02I24A5.17.10.A10.1.454.CMB.2.raw
  modified_base (371)..(371): a, c, t, g, unknown or other
  misc_feature (371)..(371): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatgtatgaattgggtgcgacacggcccccggacgaagggcttggaggtggggtgggggtgggtcgaggtcggcgtttggacggtaaggcacgagtatgcaccgagatagaggcagngtcacgataccgacggacacccccacgaacacacgtactacatgacaactgaacgagccgtagagagacgtacgacgacgaccgggtccgtactattacgtgtgacgtagtaattgttttctgtctatcgtaactagtttacgattacggctacgtacgtggtacgtcggtacttcggtacggggg

SEQ ID NO: 340182 - DNA, 594 bp, Homo sapiens
  misc_feature: GZ8MTXP02HQTVX.17.10.A10.1.454.CMB.2.raw
  modified_base (290)..(290): a, c, t, g, unknown or other
  misc_feature (290)..(290): n is a, c, g, or t
  modified_base (371)..(371): a, c, t, g, unknown or other
  misc_feature (371)..(371): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaaattgggtgcgacaggccccccgganaaggggcttggaggtgggtggggtgggtcgagcggctttgacggtaaggcacgagtatgccaccgaagagtgaagggcagngtcaagattaccgacgacacccccagaacacagtctacgatgacaactgaacgagcctagacgagcctaggacgacaccgggtccgtctaacgttactaggtcgccgaaggtaaacttggttttaccgtgttacgaacttcggttaaactaaagttttcggaaagttcggggtccttcgttaagttcggggtaactcgggtaaccgttcggttaacccggggg

SEQ ID NO: 340183 - DNA, 642 bp, Homo sapiens
  misc_feature: GZ8MTXP02F8KD5.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacgacggcccccggaagaagggcttggagggtggggtgggggtgggtcgaggcggtcgtttaggacgggttaaggccacgagtagtgaccaaccgaagtagtaggaagggacaggcgtacgacgtactaccgaccggaccacccccgaagaaacacacgtctaacgatcgacaacgtagaacgacgacccgtggaaacgacgtcgtagggaacccgaccgaaccggggtcccgttacttaacgttaccggtgtacggtcgtaaagtaagtttcgttttctacggttactacgttaccgtaaattagttttacgagttaacggtccttacgtagtacggtacttacggtccgtttcgggaccggggg

SEQ ID NO: 340184 - DNA, 716 bp, Homo sapiens
  misc_feature: GZ8MTXP02G4DQE.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggacggtcaccatctctgctctcgaacccccatgtgatcaatatgtgtctggtacagcaacgtccggatccacgacccccaaactcctacatactatacgaaagtaactaaataacgaccgacccgtacggtacggggttacccctacgtaccgtaacttctcgtcggtaccttaccgtaaacgttcgtacgggtacctaccgttccgtaccgacccccgtaacccgtcgggggaccctaaccgtcccgaaccccggtcccggtacctacccgaacggacggtacgggggaccgacgggtacccgtagttaactttcgtcggaccgtaacaaacgtacgtaggggtaccttacccgacgtaccgttacgttaaccgttcggttacgggggttcgttaccgggacggtaacggggttacgggaaacccgtaaacgtcccggttaccggtaacccgttaccggttacgggtaccaaccggtaccccggaacggtacccgttccccccgggg

SEQ ID NO: 340185 - DNA, 617 bp, Homo sapiens
  misc_feature: GZ8MTXP02FSNE2.17.10.A10.1.454.CMB.2.raw
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (442)..(442): a, c, t, g, unknown or other
  misc_feature (442)..(442): n is a, c, g, or t
  modified_base (533)..(533): a, c, t, g, unknown or other
  misc_feature (533)..(533): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagacgccgtggggcatcagtgactgtctcctgcaaggccagtggatatatcttacaactaaaatntaggtatgaagttgggngacgacgacggcccccggagaagggcttgagggtggggtggggtggtcaggtcggtcgtttaggacggtaaggcacgagtangacccacgagagtagaaggcagngtcacgtataccgacgaccaccccacgaaacacacgtctaacatgacaaacgtgaacgngcctaggacgactacgtacgaaccggaccgtaccgggtccttacgttacttacgtggtacgaacggtaagttaacgttttcgttttaccgnggttacctacgttaccgtaattaagttttcgaagttacgcctttagtacgttaggtacgttacggtacgtttcggacccggggg

SEQ ID NO: 340186 - DNA, 600 bp, Homo sapiens
  misc_feature: GZ8MTXP02GVHQK.17.10.A10.1.454.CMB.2.raw
  modified_base (288)..(288): a, c, t, g, unknown or other
  misc_feature (288)..(288): n is a, c, g, or t
  modified_base (374)..(374): a, c, t, g, unknown or other
  misc_feature (374)..(374): n is a, c, g, or t
  modified_base (517)..(517): a, c, t, g, unknown or other
  misc_feature (517)..(517): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaaatatggtatgaattgggtgcgacacggcccccgganaagggcttggaggtggggtggggtgggtcgaggcggtctttggacggtaaggcacgagtatgccaccgaagagtggaagggcaggngtcaacgtacttaccgaccgacacccccaagaaccacacgtcaacatgacaactcgaacgtacgcctagacgagactcggaccgacgaccgggtcccgtacgttaagttaccgtggtcgaccgaagtaagttcgtttttacgngttctacgttaccgtaacttacgtttagacgttacggtcttacgttagtacggtacgttcggtaaccgtttcggtaccggggg

SEQ ID NO: 340187 - DNA, 567 bp, Homo sapiens
  misc_feature: GZ8MTXP02IBTA5.17.10.A10.1.454.CMB.2.raw
  modified_base (465)..(465): a, c, t, g, unknown or other
  misc_feature (465)..(465): n is a, c, g, or t
  modified_base (510)..(510): a, c, t, g, unknown or other
  misc_feature (510)..(510): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgccggcccccggacaggagtcaccatctctgctctacgaaccccccatgttgattcattatgtgtctgtacagcacgtccggatcacgccccaaactcctcatatatagaagataaatacgaccgtaccctcgacggggttcccctacgaccgtattctcgtcggcctccgaagtctggcctacgtctcgccctacccgtggccactccgaccgccgcctacccgaggacggtcggggacgacggccgtagttacttcgtgccgtaccgaacngtcgggtaacttccgagtccgtgtacgttcggtggggtcgttcgngtacggtcggaccagtcgtacgccgttacgtacggtccagtcccgaggcctccccgg

SEQ ID NO: 340188 - DNA, 533 bp, Homo sapiens
  misc_feature: GZ8MTXP02F9BVO.17.10.A10.1.454.CMB.2.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (454)..(454): a, c, t, g, unknown or other
  misc_feature (454)..(454): n is a, c, g, or t
  modified_base (501)..(501): a, c, t, g, unknown or other
  misc_feature (501)..(501): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacaggcccccgganaacgggcttggagtggggtggggtgggtcgaggtcgggctttggacggtaaggcacagtatgccacgagatggaaggcagngtcagactaccacgaccaccccacgaacacagtcanatgacactgaacgnacctganagctgacgacacgggcctctattacgngtcgacgagtattcgtttatgtactatcgtatatttacgattacggnttactagttcggacttggactttcgtacgggg

SEQ ID NO: 340189 - DNA, 700 bp, Homo sapiens
  misc_feature: GZ8MTXP02GRRGK.17.10.A10.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaanaaatagtggtatgaagttgggngacgacgaccggcccccggagaagggtcgttaggagggtggggtaggggtgggtcgaggtcggttcgtttagggacggtaaggctaacgagtagtcgacccgaaccgaagagtaggaaaggggcaaggcgtacgaacgtacgtaacccgaaccggacccaacccccgaacgaaaccagtaccgtactaaccagtacgaacctaacgtaggaacgacgcgtaggacgacgcgtaacggccgaaccgtaccgggttccctaacgttacgtttacggtagtacggacgttaaggttaactttcggttttccgtaggttacttaactttaaccggttaaactttaaacgttttggaacgtttacgggtaaccttagttaaacggtcgggtaaccgtttagggttaccggtttacggggacccggggg

SEQ ID NO: 340190 - DNA, 818 bp, Homo sapiens
  misc_feature: GZ8MTXP02IHKF5.17.10.A10.1.454.CMB.2.raw
  modified_base (278)..(278): a, c, t, g, unknown or other
  misc_feature (278)..(278): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagaagccgtggggcatcagtgactgtctcctgacaggcagtgatatatcttacaataaaatagtaggtataggtaagttgggngacggaccgaccgggacccccggaagaagggtcgtttggagggttgggggtggggtgggtcgaggtcgggtcgtttagggacgggtaaggcaacgtagtagtcgaccccgaaccggaagagtagggaagggtacaaggacgttaccgaaacgtaaccgttaaacccccggaacccgggaacccaaacccccccaaacgggaaacctacgaaaccggtttaccaacgtacttaacgacaaccgttacggaaccggaacgtccgaaggaacggaacgtaccgtacgggaaacccggacccgtaccggggttacccccttaagtttaaccgtttacgtcggggttaacggaaccggtaaaggtttaacgtttttcggttttttacgtacgggtttaaaccgtactttttaaaccggttaaaaccgttttagtttttaacgggttaaccgttaaacggggtttaacctttaaccggtttaaggttaccgggggttaacgttttacccggggtaacggtttttacccgggggaaaccccgggggg

SEQ ID NO: 340191 - DNA, 582 bp, Homo sapiens
  misc_feature: GZ8MTXP02FNQMN.17.10.A10.1.454.CMB.2.raw
  modified_base (293)..(293): a, c, t, g, unknown or other
  misc_feature (293)..(293): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaacaaaatatggtatgaattgggtgcgacacggccccccgganaagggctttggaggttggggtggggtgggtcaggcgggtctttggacgggtaggcacagtatgaccaccganagtagaagggcagngtcaacgattaccgacggaccacccccaagaaacacacgtcacatacgacaaactgaaccgngacctagaaacgngacgtgaaccgacgacgggtacccgtacttaattaccgtggtcgacggagtaacttggttttcaggtcagttcgtaaactatttcggataggcgttactaagtcggtactacgtcgtttcgacggggg

SEQ ID NO: 340192 - DNA, 701 bp, Homo sapiens
  misc_feature: GZ8MTXP02HH0HN.17.10.A10.1.454.CMB.2.raw
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttacaacaaaatntaggtatgaagttgggtgcgacacggcccccgganaacgggtcttggaggtggggtggggtgggtcgaggcgggtcgtttagggaacggggttaaggctaacgtaggtatcggaccccgaaccggaagagtagggaaacggggccaaggtacggtaccgaaacggtactttaaacccccgaaccgggaaccccaaaccccccgaacggaaaccaccgtaacggtacctaacaagttacgacaaacgtcgaacgacgccgtaggaacgaggacgtacggaaccgaccgaccgggtacccgttacttaacgtttaccgtggttacgaccgtaaggtaagtttcgttttacgtgttacctagttaccggttaaacttaacgtttagaacgttaggtccttaggtacgttacggggtaactcggtaacggtttccggtaacggggg

SEQ ID NO: 340193 - DNA, 649 bp, Homo sapiens
  misc_feature: GZ8MTXP02G1O2G.17.10.A10.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacanaaaatntggtatgtaattgggtgcgacacggccccgganaagggctggagggtggggtggggtgggtcgaggcgggtctttgggaacgggttaaggcgaacgaggtatggaccctaaccgaagagtaggaacggggacaaggacgtacgaacggtaacttaacccgaccggaacccaccccccgaaagaaccacgtacgactacatcgacaacgtgaacgagtaccgagaacgagctacggaaccgaaccgaccgggtacccgtactaagttacgtggtcgaccggtagtaagtttgttttacctgttaccgtaagttccggttaaacttaacgtttcgtaagtttacgggtcttaccgtagttacggacgttacggtacgtttcgggtaccggggg

SEQ ID NO: 340194 - DNA, 635 bp, Homo sapiens
  misc_feature: GZ8MTXP02INLGI.17.10.A10.1.454.CMB.2.raw
  modified_base (278)..(278): a, c, t, g, unknown or other
  misc_feature (278)..(278): n is a, c, g, or t
  modified_base (565)..(565): a, c, t, g, unknown or other
  misc_feature (565)..(565): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaggccagtgatatatcttacaacaaaatatggtataggtaattgggngcgacgacggcccccgagaagggcttggagggttggggtgggggtgggtcgagggtcggtacgttttagggacggttaaggcaacgagtacgtgaccccaaaccggaagatagggaagggactaggaggtacaacgtactaacccgacggaacccaacccccgaagaaacctacaagttaccacagtcgactagacgacggacgtccgaggagacgcgtacggaaccgaccggaccgggtaccgttacgttagttacgtggtagacgtaagtaattccgttttacgngttaccagttaccgttaactaattcggtaataggtccttgtagtcggtactcggtaactttcggacgggg

SEQ ID NO: 340195 - DNA, 666 bp, Homo sapiens
  misc_feature: GZ8MTXP02HI4FI.17.10.A10.1.454.CMB.2.raw
  modified_base (490)..(490): a, c, t, g, unknown or other
  misc_feature (490)..(490): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatggaaattggggtgcgacgacggacccccggacgaaagggccgttggagggttggggtgggggtggggtcgaggtcgggcgtttgggaacgggttaagggcaaccgagtagtgaccgaaccgaagagtaggaagggcaggagtcaagaacttaccgaacggaccaacccccaagaaccacacgtactaacatgacaaactcgaacgacgacccgagaagagacgnggaaccgaccgtaccgggacccgtacttaacgttaccgtagtcggaccgtaagtaaaagttggtttttcctaggtttacctaattacggttaaaccttaagtttacgtaaagttacggtaacccttacgttagttacgggtaacgttcggtaaccgttttcgggtaacccgggggg

SEQ ID NO: 340196 - DNA, 533 bp, Homo sapiens
  misc_feature: GZ8MTXP02FH778.17.10.A10.1.454.CMB.2.raw
  modified_base (375)..(375): a, c, t, g, unknown or other
  misc_feature (375)..(375): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (464)..(464): a, c, t, g, unknown or other
  misc_feature (464)..(464): n is a, c, g, or t
  modified_base (482)..(482): a, c, t, g, unknown or other
  misc_feature (482)..(482): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacacggcccccggacaaggggctttggaggtggggtggggtgggtcgaggcggtctttggacggtaaggcacagtatgccaccgaagatgaaggggcagngtcacgattaccacggacacccccagaaacacagtctacatgacaaactgaacgngccctgagngctgacgacacgggcctctattacngtcgcgagattggtttcngtcatcgtacaatttgataggctctaagtcggactcggactttcgcggggg

SEQ ID NO: 340197 - DNA, 655 bp, Homo sapiens
  misc_feature: GZ8MTXP02JY0C5.17.10.A10.1.454.CMB.2.raw
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcgagtgactgtctctgcaaggccagtgatatatctcaacaaaatntgtatgaagttgggtgcgacgacggcccccgganaagggtcgttggagggttggggtggggtgggtcgaggccggtcgtttagggaacgggtaaggcaacgtagtagtcggaccgaaccgaaagagtagggaaggcagacgtacgaacgtacgttaacccgaaccggaacccaaaccccccgaaacgaaaccaaccgtaacgtaccgtaacgactacgacaaacgtacggaaaccgcgacctaggacgacgcgtagaaccgacgaccgggtcctacttaacgttacgtgtcgacgtaagttatttcgttttactgttactacgttacgtaaacgttaagtttcgtaaagttacgtcgtacgttagtacggtacgttcggtaccgtttcggaccggggg

SEQ ID NO: 340198 - DNA, 647 bp, Homo sapiens
  misc_feature: GZ8MTXP02HJ56P.17.10.A10.1.454.CMB.2.raw
  modified_base (475)..(475): a, c, t, g, unknown or other
  misc_feature (475)..(475): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacaacaaaatatggtatgtaattgggtgcgacgacggcccccggaagaagggctttggagggttggggtggggtgggtcgaggcgggtcgtttaggacgggtaaggcaacgtaggtatgcccgaaccggaagagtagggaaaggggccaaggacggttcaacggtacttaacccgaaccgggacccaaacccccgacgaaacctacagtacctaacatcgacaaacncgaacgaacgcccgagaagacgtacgtagaccggaccacggggcccctattaacgtaccttggtacgaccggtaagtaagttcgtttttaacgcgttactacgttacgttaaacttaagttttacgaagttacggtcttactaagtcggtattcggaactttcggacggggg

SEQ ID NO: 340199 - DNA, 521 bp, Homo sapiens
  misc_feature: GZ8MTXP02HRC8C.17.10.A10.1.454.CMB.2.raw
  modified_base (365)..(365): a, c, t, g, unknown or other
  misc_feature (365)..(365): n is a, c, g, or t
  modified_base (443)..(443): a, c, t, g, unknown or other
  misc_feature (443)..(443): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtaatgaattgggtgcgacaggcccccggacaagggcttgagtgggtggggtgggtcagcggctttgacggtaagcacgagtatgccaccgaagatgaagggcaagngtcacgattaccacggacacccccacgaacacagctacatgcaactgacgagcctgagagctgacgactacgggcctntatactgtgcagaatgtttctgtcatcgtacaatttagataagggtctcgtatcggactcggtactttaccgtggggg

SEQ ID NO: 340200 - DNA, 649 bp, Homo sapiens
  misc_feature: GZ8MTXP02GT1CV.17.10.A10.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (382)..(382): a, c, t, g, unknown or other
  misc_feature (382)..(382): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnaacaaaatatgtatgtaattgggtgcgacacggcccccgganaacgggcttggaggtggggtggggtgggtcaggcgggtctttagggacggtaggcagagtagtgaccgacgaagagtaggaaggggcaaggngtaccaacggtacttacccgaacggaccaacccccgagaaaccacacgtctacgatcgactaacgtgaaccgagccgtagagacgtccgtaggaccgaaccgaccgggacccgttacgttaactttaccgtgggttacgaccggtaagtaacgtttcgttttaccgtggttacctacgttacgttaaaccgttaagttttacgaagtttacggccttacgttaaggtcggtaacgtttacgggaacccgtttcggggtacccggggg

SEQ ID NO: 340201 - DNA, 648 bp, Homo sapiens
  misc_feature: GZ8MTXP02GQZAJ.17.10.A10.1.454.CMB.2.raw
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggctgaggtggggtggggtgggtcaggcggtctttggacgggtaaggcacgagtagtgacccaccggaagagtaggaaagggcaaggagtcaacggtacttacccacgggaccaacccccgaacgaaaccacacgtctaacatcgaccaactgaacgagcccgtggacgagctacggaacgaccgaccgggtccgtacgtaacgttaccgtggtacgacggtaacgtaaatttcggtttttactcgttacgtaacgtttaccggttaaacttaaacgtttttacggaagtttaacggtccctttaacgttaacgttacggtacccgttaggttaaccgtttcggtaacccgggggg

SEQ ID NO: 340202 - DNA, 632 bp, Homo sapiens
  misc_feature: GZ8MTXP02FYFLI.17.10.A10.1.454.CMB.2.raw
  modified_base (256)..(256): a, c, t, g, unknown or other
  misc_feature (256)..(256): n is a, c, g, or t
  modified_base (373)..(373): a, c, t, g, unknown or other
  misc_feature (373)..(373): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtgcgacgacggcccccggagaagggcttggaggtggggtggggtggtcgaggcggtctttggacggtaggcacgagtatgccacgaagagtagaagggcaggngtcaacgtattacccgacggaaccacccccaagaaaccacacgtactaacatacgacaactgaacgagcctagagtacgactacggaacgaccgacggtacccgttacgtactttacgtcggttacgacggtaaagtaacgtttggttttacctaggttacctacgttaccggttaaacttaacgttttacggaagtttacgggtctttaccgttaggttacgggtaccgttagggtaaccgtttcgggtaaccggggg

SEQ ID NO: 340203 - DNA, 613 bp, Homo sapiens
  misc_feature: GZ8MTXP02ILV52.17.10.A10.1.454.CMB.2.raw
  modified_base (290)..(290): a, c, t, g, unknown or other
  misc_feature (290)..(290): n is a, c, g, or t
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtgatatatcttcaacaaaatatggtaatgaattggggtgcgacacggcccccgganaagggtcttgaggtggggtggggtgggtcaggtcggtctttaggacggtaaggcacgagtatgaccaccgaagacgtaggaaggcagngtcacgattaccacggacaccccacgaacacacgtcacatcgacaacgtgacgagcctgagacgcgtaggaccgacgtacgggacccgttacgtaacttacgtagtcggaccgtaagtaaactttcggtttttactcgggttactactttaccggtaaacttaagtttacggtaattacgggtaacttacgtagttacgggtaacgttcgggttaaccgtttacggttccggggg

SEQ ID NO: 340204 - DNA, 611 bp, Homo sapiens
  misc_feature: GZ8MTXP02GLZVL.17.10.A10.1.454.CMB.2.raw
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacacggcccccggagaaagggtcttggaggtggggtgggggtggtcgaggcggtctttggacgggttaaggcacgagtagtcgccacgaagatggaaggcagngtacacgacttaccgaccggaccacccccaagaaccactacgtactacagtacgacaactacgacgagcccgtagacggaagtcgacgacggaaccaccgggaccgtcttacgttacgtgtaggaccgtaagtaactttgttttactcggttactacgttaccgtaacttaacgttcggaatttaacgggcttacgtaagtcggtacgttacggtaccgtttcggtccggggg

SEQ ID NO: 340205 - DNA, 543 bp, Homo sapiens
  misc_feature: GZ8MTXP02FW61Y.17.10.A10.1.454.CMB.2.raw
  modified_base (249)..(249): a, c, t, g, unknown or other
  misc_feature (249)..(249): n is a, c, g, or t
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttnacaaaatatggtatgaattgggtgcgacacggcccccggacaagggctgaggtggggtggggtggggtcgaggcggtntttggacggtaggcacagtatgcacgagatgaggcagngtcagataccacgacaccccgagaaacacagtctacatgacaactgacgagccagagagctagacgacgacggccgtactattacgtcgtgacgagtaattcgtttctgtactactacggttactaacgtttacgataaggtcttacgtagtaggacgtagtacgttacggtcggggg

SEQ ID NO: 340206 - DNA, 706 bp, Homo sapiens
  misc_feature: GZ8MTXP02J2O6V.17.10.A10.1.454.CMB.2.raw
  modified_base (297)..(297): a, c, t, g, unknown or other
  misc_feature (297)..(297): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctcctgcaaggccagtggatatatcttacaacaaaatatggtatagaagttgggtgcgacgacggacccccgganaagggtcttggaggtggggtgggggtggtacgaggcggtcgtttaggacggtaaggcacgagtagtcgacccacgaagacgtagggaagggcaagggcgtacgaaacgtacgttaacccgaaccggggaaccccaaaccccccgaacggaaaacccaacgtaacgtaccctaaacagtacgacaaaccgtcggaacgacgcctaggacgtacgcctacgggaaccgaaccgccggggtacccgtttactaacgtttaacgtacgggttacggaccggtaaagttaaacgtttcgtttttacgacggttaccaaaggtttccggttaaacttacggtttagaacgttacgggtaacttaccgtaaggttcgggtaaacttcggggttaaccgtttcgggtaacccggggg

SEQ ID NO: 340207 - DNA, 671 bp, Homo sapiens
  misc_feature: GZ8MTXP02JFN5A.17.10.A10.1.454.CMB.2.raw
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctctgcaaggccagtgatatatctacacaaaatntggtatgaattgggtgcgacgacggcccccggaagaacgggtcgttaggagggtcggggtggggtagggttcaggcggtcgtttagggaacgggtaaggcacgagtagtcgacccgaccggaagacgtagggaacggcgagacggtccaaaggtaccttaacccgaacgggacccaacccccgaagaaaccaacgacgttctaaccgagtacggacctaacgtcggacgaacgcccgtaggaacgacgtacgacgaacgaccgtaccggggaccttactaacgttacgtgttacggacgtaagttaacgttcgttttacgtacggtactaacgttacgtaacttaacgtttgaacgttaggtaaccttacgtaggttaccggggattacgggttaaccgtttcggggtacccgggg

SEQ ID NO: 340208 - DNA, 707 bp, Homo sapiens
  misc_feature: GZ8MTXP02G8J9A.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgtaattgggtgcgacacggcccccggagaagggtcttggaggtggggtggggtggtcgaggcggtcgtttggacgggtaaggcgaacgtagtagtcgacccgaaccgaagtacgtaggaacggggtacgaaggtacgtaccgaacggtaacttaaccccggaacccgggaacccccaaaccccccgaaaccgggaaaaccctaaaccgaaaccggttaccctaaaccgacgttaccggtaaccaaaccggttacgaaccggaacgacccgtaggaacgtacgacgtacgacgtaaccgaccggtcccgtacttaacgttacgtcggtacgtacggtacgttaaagtttcgttttacgtcggttactacgttacgttacttaacgtttgtaacgttagtaacgtcgttagtacggtacgttcgggtacctttcggtaccggggg

SEQ ID NO: 340209 - DNA, 645 bp, Homo sapiens
  misc_feature: GZ8MTXP02FGFUP.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntggtatgaattggggtgcgacgacggcccccggagaagggcttaggaggtggggtggggtggtcgaggcggtctttggacgggtaaggcacgagtatgacccaccgagataggaaaggggcctaaggacgcgaacgtattacccgaaccggaacaaccccccaagaaacaacgacgttaccaacagcgacaactacgacgacgcctaggagacgtacgacggaaccgaccgtacccgggtaccttacgttaacgttacgtacggtacgacgtaacgttaagtttcgttttacgtacgttacctaacgttacgttaaacgttaacgtttcgaacgttacggtaacttacgttacgtacggtacgttacggtaccgtttcgggaccgggg

SEQ ID NO: 340210 - DNA, 558 bp, Homo sapiens
  misc_feature: GZ8MTXP02GKUSP.17.10.A10.1.454.CMB.2.raw
  modified_base (291)..(291): a, c, t, g, unknown or other
  misc_feature (291)..(291): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatataggtatgaattgggtgacgacacggcccccgganaaggggcttgaggtggggtggggtgggtcgaggcggtgtttggacggtaaggcacgagtatgccaccgaagatggaaggcagacgtcaacgacttaaccgacggaaccaacccccgacgaaaccacgaacgtactacatcgacaacgtgaacgacgcctagagtagcgagacgacgacggcgtactagtctgtagcgagtaattcgtttcagtacacgtacgtactaattgataggctctagtcggactcggtacttcggtacgggg

SEQ ID NO: 340211 - DNA, 791 bp, Homo sapiens
  misc_feature: GZ8MTXP02IXPCQ.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaaggccgtggggcatcagtgactgtctctgcagcagtgatatatctacaacaaaatgtaggtatagtaagttgggtagacggacgaccgggacccccggaacgaacgggtcgttagggtaggggtggggtgggggtcgggtcgacgggtcgggtacgtttagggaacgggttaaggcgaaacgtaggtagtacggaacccgaaccggaaaggtagtaaggggaaacggggaccgaaggtacggtaccgtaaacggtaaaccgttaccccggaaaccccgggaacccccaaaccccccgaaacggaaacccaaacgtaccggttaaccctaaacgtacgttaaccggaaccttaaaccggtacgggaaacccgaacggtacccgtaagggaaacgggaccgttaccgtaacgggaacccgggaacccggtacccggggttaccgttaaccttaacggtttaccggttagggtaacgtaccggtaaagtttaacgtttacgttttcgacggttactaaacgtttaccgttaaacttagttagacgttagtaaccttagtagtcggtacgtacggtaccgtttacgggaccgggg

SEQ ID NO: 340212 - DNA, 672 bp, Homo sapiens
  misc_feature: GZ8MTXP02HQC24.17.10.A10.1.454.CMB.2.raw
  modified_base (252)..(252): a, c, t, g, unknown or other
  misc_feature (252)..(252): n is a, c, g, or t
  modified_base (560)..(560): a, c, t, g, unknown or other
  misc_feature (560)..(560): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcgagtgactgtctcctgcgaagcagtgatatatctacaanaaatatggtatagtaagttgggtgacgacgacggacccccggagaagggcttggagggtggggtaggggtggtcgaggtcggtcgttttagggaacggttaggacgacgtaggtactacggaccccgaaccggaaagtacgtagggaaaggggaccgaagggacgttaccgaaacggtaacgttaaacccggacccggaaacccacccccgaacgaaaccacacgtactaaccgatacgacaacgtaggaaccgacgtccgagacgacggacgttacggaccgacgaccgggtcgtacgttattacgngtacggcgtaagtacgtttcgtttctacgtactacgttacggtaatttaacgttacgagttacggaaccttagtacgttacggacgttacggtaccgtttcggacccggggg

SEQ ID NO: 340213 - DNA, 770 bp, Homo sapiens
  misc_feature: GZ8MTXP02JTBIU.17.10.A10.1.454.CMB.2.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcggccggcccccggacgaggaggtccaccatctcttgctctacgaacccccatgtgatcatngtntctgacancacgccggancacgccccaactcctacatatatagaaagaataataacgaccgtacccgtacgtacggggttcccctacgaccgtacttccgtacgtcggtacctaccgtaacgttcgtacggcctaccgttccgtaccggcccctaccccggttggggacctacccgttacccgaacccggcccgtacccgtacccgaacggggtaaccgggtcggggggaaacccggtaacgggggtaccccggttaaggtttaccgttttccggagggtaccccggaaccgtaaaccggtaggtaccgggggttaccttaccccggtaacggtccccgtttacggttaacccggtttacggggtttcggggggttaccgggtttccgggaccggttaaacgggggtacccggggtaaacccgtaaacgggtcccggttaccggtaacccggttcccgtaacggggttaccccgaaccggtacccccggaaacgggtcccgttaccccccggg

SEQ ID NO: 340214 - DNA, 667 bp, Homo sapiens
  misc_feature: GZ8MTXP02IZFGF.17.10.A10.1.454.CMB.2.raw
  modified_base (382)..(382): a, c, t, g, unknown or other
  misc_feature (382)..(382): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccggagaaggctgaggtggggtggggtggtcgaggcggtcgtttggacggtaaggccaacgagtagtgacccgaccgaagagtaggaagggccgaagngtccaacggtaacttaccgaaccggaccaacccccgaacgaaaccacaacgtctaacatcgacaaacgtcgaacgacgccagaacgagaccacggaccgaccgaccgggtacccgttaccttaacgtttaccgtggttaggtaccggtaaaggtaaacgtttcgtttttacgacgtttacgtaacgttaacccggttaactaacggtttttaacgaacgtttaacgggtcttacgttaaggttacggtaaacgtttcgggtaaccgtttcggggtaacccggggg

SEQ ID NO: 340215 - DNA, 591 bp, Homo sapiens
  misc_feature: GZ8MTXP02F1TP5.17.10.A10.1.454.CMB.2.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (387)..(387): a, c, t, g, unknown or other
  misc_feature (387)..(387): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttnaacaaaatntggtatgaattggggtgcgacacggcccccggagaagggcttggagggtggggtgggggtgggtcgaggtcggtcgtttggacggtaaggcacgagtatggaccaccgaagagtaggaagggcaaggngtcaacgtattaacccgacggaaccacccccaacgaaaccacacgtctaacatgacaactgaacgagcctagagagctagacgacacgggccgtacctaattctgtgacgtaagtaacgttgttttacctgttactacgtacgttaactaagtttagagtttacggcttacgtactaggtaccgttggtacttcggtacggggg

SEQ ID NO: 340216 - DNA, 690 bp, Homo sapiens
  misc_feature: GZ8MTXP02I5VCU.17.10.A10.1.454.CMB.2.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
tcagcgtagactagcacgaccggtgctcgatttagcgtcgatctcagggggacccaaaaaccacacccctccttgggagaatcccctagatcacagctcctcaccatggactggacctggagttttcatccttttcctggtggcagcaggcacaggtgcccacgcccaggttcagttggtgcagactggggctgaggtgcagagcctggggcatcagtgactgtctcctgcaaggcagtgatntatcttcacaaaatntgtatgaagttgggtncgacacggccccgganaaggcttggagtgggtggggtggtcaggcggtctttgggacggttaaggcaacgagtatcgcctaaccgagagtaggaggacagcgtcgaacgataccgacgggacccaccccgaagaacctacagtacctacatacgactaacgtaggaccgtacgacccgtagaacgggacgaccgtaacggaaccgaaccggaacccgggtccggttacccttaaagtttaacccggtggttaacggaccggtaaaggttaaaccgtttgggttttacttacgggttacctagtttaacccggttaaacttaaacgttttacggtaaagttacggggtaacccgtttacggtaaaagttccgggtaaaaccgtttcgggtaaacgtttacccgggttacccgggggg

SEQ ID NO: 340217 - DNA, 711 bp, Homo sapiens
  misc_feature: GZ8MTXP02IF6D9.17.10.A10.1.454.CMB.2.raw
  modified_base (271)..(271): a, c, t, g, unknown or other
  misc_feature (271)..(271): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcagccagtggatatatcttacaacaaatatggtatgaattgggngcgacgacggcccccggagaacggggtcttggagggttggggtggggtgggtcgaggtcggtcgtttaggacgggttaaggcgacgagtatcggacccgtaaccgaagaatagggaaagggccgaaggagttccgaacgtaacgtttaaccccgaaccgggaaccccaacccccgaaacgaaacccacacggtactacgactacgaccaacgtacgaaccgacggacctaggaacgaggtaccgtacggaaccggaacccgtaaccgggacccgtttacccgttaaagtttaaccgttggtaacggtacggtaagttaaacgtttcggttttacgttagttaccgtaacgtttaccggttaaacttaacgttttagaacgttagggtaaccttacgttaagtcggtaaccgtttcgggtaacctttcgggtaaccggggg

SEQ ID NO: 340218 - DNA, 634 bp, Homo sapiens
  misc_feature: GZ8MTXP02ICF48.17.10.A10.1.454.CMB.2.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (311)..(311): a, c, t, g, unknown or other
  misc_feature (311)..(311): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttanaacaaaatatggtatgtaatgggtncgacgaggcccccggagaagggtctggaggtggggnggggtgggtcgaggtcggtctttaggacgggtaaggcacgagtatgaccgaccggaaagagtaggaacggggacaagggacgtacgaacggtaaacgtttaccccgaaccgggaaccccaaaccccccacgaaaacccgtaccaagtaccgtaaccagtacgactaaaccgtacgaaacgacgaccgtgaagtacgctacggaacgaccaacgggcctactagttacgagttcgacgtagtaattcgtttcgtagtcacgttacgtaactaactttagtaatggtctagtacgtacgtacgttcggacgtttcggtacggggg

SEQ ID NO: 340219 - DNA, 747 bp, Homo sapiens
  misc_feature: GZ8MTXP02HWE9F.17.10.A10.1.454.CMB.2.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcanaaaatntgtatgaattgggtgcgacacggcccccgganaagggcttggaggtggggtgggggtgggtcgaggcgggtcgttttaggacgggttaaggcaacgtaggtatcggacccaaccggaaagagtagggaaacggggcaagggacggttacaaaccggtaactttaaacccccgaaccggggaacccccaaaccccccgaaacggaaacccaaaccgacggttacctaaacacttacgacctaaacgtcgaacgacggccctaggaggaacggctacggaacgaaccgtaccggggacccgttacgtaacgtttaccgtaggttcggaccggaaaggttaaagtttcggtttttaacgtcgtttacggtaaactttcccggtttaaaacttaacgtttttacggaaagtttacggggtaaccctttacgtaaacggtttcgggggtaaaccgtttcggggtaaacccgtttttcgggggtaaacccgggggg

SEQ ID NO: 340220 - DNA, 639 bp, Homo sapiens
  misc_feature: GZ8MTXP02GQAX5.17.10.A10.1.454.CMB.2.raw
  modified_base (295)..(295): a, c, t, g, unknown or other
  misc_feature (295)..(295): n is a, c, g, or t
  modified_base (386)..(386): a, c, t, g, unknown or other
  misc_feature (386)..(386): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagctggggcatcagtgactgtctcctgcaaggccagtggatatatcttacaacaaaatatggtaatgtaagttggggtgcgacgacggcccccgganaaggggctttggaggtggggtggggtgggtcaggcgtccgtttaggacggtaggcacgtagtatcgaccaccggaagagtaggaaggcagngtcagactaccgacggaccacccccgaagaaccacacgtacaccatgacaaacgtgaaccgagcctagagacgctaggaaccgaaccgaccgggtacccgttacgtatttaccgtggtacgacggtaagtaagtttcggtttttactcggttacctaagttaccggttaacttaaacgttttcggaacgttaacggtcctttaacgttaagttacgggtaacgttcggtaaccgtttccgggtaaccgggggg

SEQ ID NO: 340221 - DNA, 588 bp, Homo sapiens
  misc_feature: GZ8MTXP02FYJTU.17.10.A10.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatataggtatgaaattggggtgcgacacggcccccgganaagggcttgnggtgggtggggtgggtcaggcggtcgtttggacggtaagggcacgagtagtgccaccggaanagtgaagggcaggagtcaacgattacccgacggaccaacccccgacgaaaccacagtctaacatacgacaacgtgacganccgtagagagtcgacggacgaccgacgggtacctacgtattaactgtagacgagtaagttgtttactgtactagttacgtaactaacgtttgagttacggtccttagtacgtacggacttacggtacctttcggtaccggggg

SEQ ID NO: 340222 - DNA, 675 bp, Homo sapiens
  misc_feature: GZ8MTXP02F3WC5.17.10.A10.1.454.CMB.2.raw
  modified_base (271)..(271): a, c, t, g, unknown or other
  misc_feature (271)..(271): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagtacaggtgcccacgcccaggttcagttggtgcagactggggctgaggtgcagaagccgtggggcatcagtgactgtctcctgcaaggccagtggatatatcttcaacaaatntggtatgaagttgggtgcgacgacggcccccggagagggcttggaggtggggtggggtggtcgaggtcggtcgtttggaacgggtagcacgtagtatcgacaccgaagactggaagggcaggacgtacgaacgacttacccgaacggacccaacccccaacgaacaaccagtacaacagtacgacctaaacgtacgaacgacgtaccgtaggaacgacggccgtacggaaccggaaccgaccgggtacccgttacttaacgttaaccgtggttacgaaccggtaagttaacgtttcgggtttttactacggttaccttaagttaccgttaaacttaaagtttacgtaagttaacgggtaccttacgttaggttacgggtaaccgttgggtaccgtttccggggg

SEQ ID NO: 340223 - DNA, 579 bp, Homo sapiens
  misc_feature: GZ8MTXP02I707Y.17.10.A10.1.454.CMB.2.raw
  modified_base (421)..(421): a, c, t, g, unknown or other
  misc_feature (421)..(421): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcgaaccccccatgtgatcatatgtgtctggtaccagcaacgtccggatcacgccccaaactcctcatactatgaagtataagtaagcgtacccctcgtagggtcccctagacccgtattcctcgtacgctccaagtctggccacgtctcgccgaccctggcgtactcgaccgccgactccgagccgtgggacnggccgtagtagttctgcgcaacgngtggacttcgagtccctgacgttcgtcggggtagttccgggacgaacggttcgggaacctaacggcgttacggaaccccggttcccgttaaaggtccccgaacgtacccccgaacggggtcctttacccccggg

SEQ ID NO: 340224 - DNA, 667 bp, Homo sapiens
  misc_feature: GZ8MTXP02GJLKW.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatagtaagttgggtgcgacgacgggcccccggacgaagggtcttaggagggtggggtggggtggggtcgaggtcggtcgtttggaccgggttaaggcgacgagtacgtgaccccgaaccgaagtagtaggaacgggacaggacgtacaacggaacttacccgaaccgggacccaaccccccgaacgaaaccacgaacgtcctaacactagacaacgtagacgacgccgtagaacgagacgtacgacggaccgacccgggccgttacgttagttaccgtgtcggacgtaagtaacgtttggttttcctggttactacgtttacgtaaccgttaaactttggaacgttacgggtaacttaccgttagttacggtaccgttacggtaaccgtttcggtacccggggg

SEQ ID NO: 340225 - DNA, 599 bp, Homo sapiens
  misc_feature: GZ8MTXP02GAGJJ.17.10.A10.1.454.CMB.2.raw
  modified_base (252)..(252): a, c, t, g, unknown or other
  misc_feature (252)..(252): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagccggcacaggtgcccacgcccaggttcagttggtgcagactggggctgaggtgcagaagccgtggggcatcagtgactgtctcctgcaaggccagtggatatatcttcaanaaatatggtatgtaagttggtgcgacgacggcccccggaagaagggtcttggaggtggggtggggtgggtcaggcggtcgtttaggacgggttaaggcacgtagtatggaccaacccgaagagtaggaaggcaggacgtcacgtactaaccgaccgaacccaacccccgaacgaaacacacgtactaacatcgacaaactcgaacgaacgcccgtagacgagaccgtaggaaccgacgacccgggtcctacgttacgttacgtgtacgagtataagttgtttctgtacattacgtaataatttgaattggtactgtagtagtactggtacgttcggtacgggaccgg

SEQ ID NO: 340226 - DNA, 538 bp, Homo sapiens
  misc_feature: GZ8MTXP02JL8HK.17.10.A10.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacaggcccccgganaagggcttgaggtggggtggggtgggtcaggcggctttggacggtaaggcacgagtatgccaccgaagataggagggcagngtcacgattaccacggaccacccccacgaaacacaacgtctacgatgacaacgtgacgagcctagagacgctgacgacgacggccgtctattactgtgcgagtaatgttttacngttcacttcgtaactagttnagtagtctntagtcggtataggtacttcgtcgggg

SEQ ID NO: 340227 - DNA, 580 bp, Homo sapiens
  misc_feature: GZ8MTXP02JMKPN.17.10.A10.1.454.CMB.2.raw
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
  modified_base (435)..(435): a, c, t, g, unknown or other
  misc_feature (435)..(435): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaaggcttgaggtggggtggggtggtcaggcggtctttggacggtaaggcacgagtatgccaccgaagagtaggaaggcagngtcacgattaccacggaccacccccacgaacacacgtctacatgacacgtacgacgacgcctgagngactgaccgacgaccgggtaccgtactaagttaccgtagtgaccgtagtaagttgttttacctgttactacgttacgttaactaacgtttacgaagttacggcttacgtagttacgggtactacggtaccgtttcggtaccgggg

SEQ ID NO: 340228 - DNA, 616 bp, Homo sapiens
  misc_feature: GZ8MTXP02JAL0Y.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacacaaaatatggtatgaattgggtgcgacgaggccccccggagaagggcttgaggttggggtggggtgggtcgaggcggtcgtttaggacggttaaggctacgagtatgacccgaccgaagataggaagggcagagtcaacggtattaacccgacggaacccacccccaagaaaccacacgctacatgacactagacgagacctgacgagctaggaccgacgaccgggtaccgttacgtaacgtttaccgtggtacgaccggtaagttaaacgttcggtttttacacgttacctaagttaccggttaaacttaagttagaacttaggcttacgtaagttcggaactcggtaactttcggacccgggg

SEQ ID NO: 340229 - DNA, 621 bp, Homo sapiens
  misc_feature: GZ8MTXP02JW7F0.17.10.A10.1.454.CMB.2.raw
  modified_base (456)..(456): a, c, t, g, unknown or other
  misc_feature (456)..(456): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgacggcccccggacaacgggcttggaggttggggtggggtggggtcgaggcgggtcgtttggacggttaaggcgacagtatgcctaccgaagataggaaggggcaggagtcacgattaccgacggaccacccccaacgaaccacgagtctacgatcgacaacgtgacgagccgtagagngactgacgacgaccggtccgtactacttaacgtggtcgacggtagtaagttcggttttctacggttactacgttaccggttaacttaaacgttttcgaagtttaacgggtcccttggttaaacgttcgggtaacgttacgggtttaacgttcgggttaccggggg

SEQ ID NO: 340230 - DNA, 668 bp, Homo sapiens
  misc_feature: GZ8MTXP02IGX3H.17.10.A10.1.454.CMB.2.raw
  modified_base (305)..(305): a, c, t, g, unknown or other
  misc_feature (305)..(305): n is a, c, g, or t
  modified_base (543)..(543): a, c, t, g, unknown or other
  misc_feature (543)..(543): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctctgcaaggccagtggatatatcttacaactaaaatatggtataggtaagttgggtagcgtaccgacgggcccccggaanaaggggtcttggagggttggggtggggtcgggtcgacggcgggtctttagggacgggttaagggcgaacgtaggtagtgacccgaacggaagacgtggaagggtcagacgtcaacgtacgttacccgaccgacccaacccccgaaccggaaacaccgacgttacaacgatacgacaacgtgaacgacgaccgtagaacgcgcgtacgaacgaccgacggtccgtactacgtttaccgnggtacgcgtaaagtacgtttcgtttttacagtttactacgttacggttaaacttaacgtttacgtaattaacgggtcttaacgtaggttacgtacggttcggtacgtttacgggtaacccggggg

SEQ ID NO: 340231 - DNA, 668 bp, Homo sapiens
  misc_feature: GZ8MTXP02I79L8.17.10.A10.1.454.CMB.2.raw
  modified_base (258)..(258): a, c, t, g, unknown or other
  misc_feature (258)..(258): n is a, c, g, or t
  modified_base (493)..(493): a, c, t, g, unknown or other
  misc_feature (493)..(493): n is a, c, g, or t
  modified_base (563)..(563): a, c, t, g, unknown or other
  misc_feature (563)..(563): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaacgccgtggggcatcagtgactgtctcctgcaagccagtggatatatcttcaacaaaatntaggtatgtaagttgggtgacgacgaccgggacccccggagaacgggtcttggagggttggggtggggtggtcgaggtcggtcgtttacgggacgggttaaggcaagtagtagtagacccgaacgagagtaggaagggcaggacgtccgaaacgtacgttacccgaccgggacccaaacccccgagaaaccgactacgttacactagcgacgacgtagaccgagaccgaggacgngtaccgacggaccgtacgacgggtccttacgtacgttacgtggtacgacgtaagtaacgtttgtttacgngttactacggttaacttaacgttaagtttacgaacgtttacgggaacctttacgggtaacgttacggggtaacgttcggttaaccgtttccggggtaaccggggg

SEQ ID NO: 340232 - DNA, 672 bp, Homo sapiens
  misc_feature: GZ8MTXP02HGR1Q.17.10.A10.1.454.CMB.2.raw
  modified_base (288)..(288): a, c, t, g, unknown or other
  misc_feature (288)..(288): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggcagtgatatatcttcacaaaatatggtatgaattgggtgcgacgacggcccccgganaacgggcttgaggttggggtggggtggtcgaggcggtctttagggaccgggtaaggcgaacgtagtagtcgacccgaaccggaagaagtaggaaaggggaccaagggacggtacctaaacggtaactttaaacccgaccgggaaacccacccccccgaaagaaaccgaacacgtacacatcgacacgtagacgagaccgtagaggagactgaaccgacgaccgggtaccttacttacgttacgtggtacgtacggtagtaagtttcgtttttacgtacgtttcgtaaacgttcggttaaacttaagtttacggtaattacggggtaactttacgtaggtttacggtaacgtttccggttaaccggttttacgggtacccggggg

SEQ ID NO: 340233 - DNA, 704 bp, Homo sapiens
  misc_feature: GZ8MTXP02HBNUA.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgacaaggccagtgattatatcttacaactaaaatgtgtatagtaagttgggtgacgacgaccggacccccggaagaacgggtctttaggaggggttgggggtggggtcgggtcgagggtcgggtacgtttaggaacggggtaacggctaacgtagtacgtcggacccgaaccggaagaggtaacgggaaggggacgaaaggacggtacgtaacggtaaacgttaccccgaaccgggaaccccaaacccccgaaacgtaaacacgttaacgactacaagtacgactaacgaggaacgaccgaccgagaacgagccgtacggaaccgaccggtacccgggtacttaccttaagttccgaggttcgaacgtagtaaagtttcgttttacaggttacctagttaacgttacttaagttacgtagttaccggtaatacgttaacggtggtaacgtcggtttacgttcggggtaaccgggg

SEQ ID NO: 340234 - DNA, 664 bp, Homo sapiens
  misc_feature: GZ8MTXP02JIJLF.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggagaagggctttggaggtggggtggggtgggtcgaggcggtcgtttggacgggttaaggcaacgagtagtgcccgtaccggaagacgtaggaaggggccaaggacggttaccaacggtaacgtttaaccccgaaccggggaacccaaacccccccgaaacggaaacccaaccgtaacggtacctaacagtacggaccaaacgttcggaacgaacgccctaggaacgacggactacggaaccggacaccgggaccgttacgttaagttaccgtgttcggaccggtaagtaattgttttaccgtaggttctaacgttacgttactaagtttacgagtacggtctagttacgtaggtactaggtcgtttacggtacggggg

SEQ ID NO: 340235 - DNA, 660 bp, Homo sapiens
  misc_feature: GZ8MTXP02JAQPC.17.10.A10.1.454.CMB.2.raw
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (381)..(381): a, c, t, g, unknown or other
  misc_feature (381)..(381): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgagtgcagaagcctgggcatcagtgactgtctcctgcaaggccagtgatatatcttcaanaaatatggtatgaattgggtgcgacacggccccgganaagggcttgaggtggggtggggtgggtcgaggcggtcgtttgggacggtaaggcacgtagtagtcggaccaccggaagagtaggaagggaccgagngtaccaacggtaacttaacccgacggacccaaaccccccgaacgaaaccaacacgtacctaacgatcgaactacgtaggacccgagacccgtagacggagaccgacggaaccgaacccgtaccgggtccccgttactaacgtttacggtcggttacggaccgtaagtaacgtttcggttttactggttacctacgttaccgtaactttaacgtttacgtagttaacgggtctacgtttaggtacggttaaccgttggtaccgtttcgggtaaccggggg

SEQ ID NO: 340236 - DNA, 578 bp, Homo sapiens
  misc_feature: GZ8MTXP02FQ527.17.10.A10.1.454.CMB.2.raw
  modified_base (256)..(256): a, c, t, g, unknown or other
  misc_feature (256)..(256): n is a, c, g, or t
  modified_base (379)..(379): a, c, t, g, unknown or other
  misc_feature (379)..(379): n is a, c, g, or t
  modified_base (451)..(451): a, c, t, g, unknown or other
  misc_feature (451)..(451): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntagtatgaattgggtgcgacacggcccccggagaagggctttgagggtggggtggggtgggtcgaggcgggtctttgggacggtaagggcacgagtatgacccaccgaagataggaaggcagngtcacgtatacccgacggaccacccccgagaaacacagtctaacatcgacaactgaccgagtcccagaggancgtacgaccgacgaccgggtcctactattaccgtgtcgacgtagtaatttcgtttcgngtactagttccgtaacttaagtttcgaatagggccttacgtagtcggactggtacttcgggtaccgggg

SEQ ID NO: 340237 - DNA, 669 bp, Homo sapiens
  misc_feature: GZ8MTXP02JX78D.17.10.A10.1.454.CMB.2.raw
  modified_base (403)..(403): a, c, t, g, unknown or other
  misc_feature (403)..(403): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagaagccgtggggcatcagtgactgtctcctgcaaggccagtggatatatcttacaactaaaatgtaggtatgtaagttgggtgcgacgaccggacccccggagaagggtcgttggagggtggggtggggtggtgaggtcggtcgtttgggaacgggtaaggcaacgtagtagtcggacccgaaccgaaggtagtacgggaagggcagngtaccaacggtactaacccgaccggaacccaacccccgaacgaaaccaacgtacgtacctaacacgtacgacaacgtacggaaccgacgacccgtaggaggacgtacgtacggaccgaccggaccgggttaccgtacttacgttacgtggtacgacgtaagttatttcgttttactacgttcttacgttaccgtaaacgttagtttagtaacgttagtaaccttcgttaaggtacggtacgttcgggtaccgttcggtaccggggg

SEQ ID NO: 340238 - DNA, 634 bp, Homo sapiens
  misc_feature: GZ8MTXP02IIZ70.17.10.A10.1.454.CMB.2.raw
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgccccacgcccaggttcagttggtgcagactggggctgaggtgcagaagcctggggcatcagtgactgtctcctgcaaggccagtggatatatcttacacaaaatataggtatgaattgggtgcgacacgggcccccgagaacgggcttggaggttggggtgggggtgggtcaggtcggtctttagggacggttaaggcgacgagtatgcccaaccggaanagtaggaaggcagngtcacgacgttaacccaccgggaccaacccccaacgaaaccacacgtactacgactagacaaactgaacgagtcccagagagactggaccgacgaccgggtaccgtacgttaactttaaccgtggtacgacggtagtaaacgtttggtttttctacggttctaaacgttcggtaaacttaagttttacggattaacggtcttaccgttaaagttcggtaacgttcggtaacgttacggtttccggggg

SEQ ID NO: 340239 - DNA, 590 bp, Homo sapiens
  misc_feature: GZ8MTXP02I6X32.17.10.A10.1.454.CMB.2.raw
  modified_base (244)..(244): a, c, t, g, unknown or other
  misc_feature (244)..(244): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaagcagtgatatatctnacaaaatatggtatgaattgggtgcgacacggcccccggagaagggcttggaggtggggtggggtggtcgaggcggctttggacggtaggcacgagtatgccaccgaagngtagaggcagngtcacgattaccgacggacacccccagaaaccacgagtacgtacatcgacaactgacgtagcctagacgagcgtagacgacgacgggtccgtacgtagttaccgtggtacgcgtaagtaagtttcgttttacgtagttacctacgttacggttaacctaagtttacgagttaacgggtccttacgttagttcggtaacgttcggttaacgtttcggtaccggggg

SEQ ID NO: 340240 - DNA, 574 bp, Homo sapiens
  misc_feature: GZ8MTXP02F8KP0.17.10.A10.1.454.CMB.2.raw
  modified_base (371)..(371): a, c, t, g, unknown or other
  misc_feature (371)..(371): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctcaggtgcagaagcctggggcatcagtgactgtctcctgcaaggccagtggatatatcttcacaaaatatggtatgaattgggtgcgacacggcccccggagaagggcttggaggtggggtggggtgggtcgaggcggtcgtttggacggtaaggcacgagtatgaccacgagatgaaggcagngtcacgataccgacgacaccccagaacacagtcaacatgacaactgaacgagacctgagacgcgtaggacgacgaccgggccgttactagttactgtacgacgaagtaagtttcgttttactgttactacgttaccgttacttaagtttacgagttacggtcttactagtcggtacgttcggtaccgtttacggtaccggggg

SEQ ID NO: 340241 - DNA, 713 bp, Homo sapiens
  misc_feature: GZ8MTXP02J0Q35.17.10.A10.1.454.CMB.2.raw
  modified_base (391)..(391): a, c, t, g, unknown or other
  misc_feature (391)..(391): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatagtaagttgggtgcgacgacggcccccggaagaaggggctttggaggttggggtggggtggtcaggcggtcgtttaggacgggttaaggcaacgaggtatcgaccgacgaagtacgtaggaggcagngtcaacgtataccgacggaccaacccccgacgaaacctacgaagtcctaacatcgacaacgtagaacgaacgccgtaggaacggaacgcgtacgggaaccgaacgtacccggggtaccttacgttaacgtttaccgtagggtacggtaccggtaaaggttaaacgtttggttttttaccgacggtttaccgtaacggtttaaccggtttaaaccttaaacgttttacggttaaaacgtttaacggggtccgtttaaaccggtttaagtacccgggggttaacttccggggtttaacccgtttccggggttaaacccgggggg

SEQ ID NO: 340242 - DNA, 630 bp, Homo sapiens
  misc_feature: GZ8MTXP02JQHIV.17.10.A10.1.454.CMB.2.raw
  modified_base (445)..(445): a, c, t, g, unknown or other
  misc_feature (445)..(445): n is a, c, g, or t
  modified_base (503)..(503): a, c, t, g, unknown or other
  misc_feature (503)..(503): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctggaggtgcagaagccgtggggcatcagtgactgtctctgcaaggcagtggatatatcttacaacaaaatatggtatgaagttgggtgcgacgacggacccccggagaacggcttggaggtggggtgggggtggtcgaggtcgggtcgtttagggaacggtaggcgaacgagtatgcccgaacgaagatagggaagggcaggacgtacacgacgttacccgaccggacccaacccccgaacgaaacacagtccaacancgacactggacgtacgcctagagacgtcgacgacgacgaccggcctagtacgttacgngtcgacgtaagtatttcgttttacgacggtactacgttacgtaacgtttaagtttacgtaaggttacggtctttacgtaacgttacgggtaacgttaccggttacggtttaccgggttacccggggg

SEQ ID NO: 340243 - DNA, 650 bp, Homo sapiens
  misc_feature: GZ8MTXP02H745N.17.10.A10.1.454.CMB.2.raw
  modified_base (290)..(290): a, c, t, g, unknown or other
  misc_feature (290)..(290): n is a, c, g, or t
  modified_base (471)..(471): a, c, t, g, unknown or other
  misc_feature (471)..(471): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttcaacaaaatatggtatgtaatgggtgcgacaggcccccgganaagggcttggaggtggggtggggtgggtcgaggcgggtctttgggacgggttaaaggcgaacgtaaggtatggacccgaaccggaaagagtagggaaaggggcaaggagtaccgaaacgtacttaacccgaacggacccaacccccaaacgaaaccaacagtacctaacatcgactaacgngaacgaacgccgtaggaagacgactggaaaccgacggacgggcccgtataacgttactggtcgacgtagtaattcgttttcaggttcctagttaccggttaacttaaagttttgtaacgttagggtaacctttacgtagtacgggtaccgttacgggtacgttttcggaacccgggggg

SEQ ID NO: 340244 - DNA, 696 bp, Homo sapiens
  misc_feature: GZ8MTXP02HO6RF.17.10.A10.1.454.CMB.2.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctctgcaaggccagtggatatntcttacaanaaatagtggtatgaagttgggagacgacgacgggcccccgaagaacgggtcttggagggttgggggtaggggtcgggtacgagggtccggtagttttcgggaaaccgggttaggcgaacgaaggttacgacggaacccgaacggtaagaggtaagggaacggacgaaggtacgtacgaaacgtaaccgtaacccgaacccgaacccaaacccaaacgaactacgaacgtacacgtacgacgtacaacgtacgaacgacgtacgtagacgacgtacgacggaaccgacgtaccggtaccttatacgtagacggtagacgttaagtacgtttcgtttacgttacgttacgttaacgttacgttaacgttaacgttaacgttacgttacgttaacgttacgttacgttacggtacggttacggttacggtttacgggtacggg

SEQ ID NO: 340245 - DNA, 667 bp, Homo sapiens
  misc_feature: GZ8MTXP02IIX49.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcgagaagccgtggggcatcagtgactgtctcctgcaaggccagtggatatatcttacaacaaaatagtggtatgtaagttggtgacgacgacggacccccggagaaggcgttgagggtggggtggggtgggtcgaggtcggtcgtttttagggacgggttaacgtcgaacgtaggtagtacgacccgaaccggaaaggagtaggaaacggggcgtaacggacggttacaaccggtaactttaacccgaaccggggacccaaacccccgaaaccggaaacctaacaacggtactaacaagcgacgaactacgaacgacgaccgtagaagggactacgacggaaccgaacggaacccgggtcccgtacttaacggttacctaggtggacgtagtaattcgtttagtcgtatccgttaggtaactagttgtaaagtcgtaacgttctacgtacgtacgtacgtacgttacgtcgg

SEQ ID NO: 340246 - DNA, 697 bp, Homo sapiens
  misc_feature: GZ8MTXP02IH8GP.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgacttgtctcctgcaaggccagtggattatatcttacaacaaaatagtggtatagtaagttgggtgacgacgacggcccccggaagaaggcttggagggtggggtggggtgggtcgaggtcggtcgtttagggacgggtaaggcgtaacgaggtaagtcgaccgaaccggtaaagagtagggaaaggggcaaggtacgtacgaaacgtaacgtaacccgaacccgaacccaaaccccccgaaacgaaaccacgtaacgtacctaacgacgttacgaaccctaaacgtacgaaccgacgccgtaggaagacgcgaaggacccgacgtaccgggtaccgttacttaagtttaccgtggtcgaccgtaagtaacttgtttttcacgtttcctaaagtttaccgttaacgttaacgttttagacggttaacggtcttaacgttagtacggtacgtttacggtaaccggtttcgggacccggggg

SEQ ID NO: 340247 - DNA, 674 bp, Homo sapiens
  misc_feature: GZ8MTXP02GL72D.17.10.A10.1.454.CMB.2.raw
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatntgtatgtaagttgggtgcgacacggcccccgganaagggcttggaggttggggtggggtgggtcaggcggtctttgggaacggtaggcacgagtatgaccgaccgaagagtaggaacgggacaaggcgtacaacggtaacttaacccgaaccgggaacccaaccccccgaaggaaaccaacgtacgtacctaacaagtcgacaactaggaaccgaacgcctaggaaacgacgaccgtacggaaccgaaccgaccgggtcccgttacttaacgtttaccgtaggtacggtacgttaacggttaaagtttcggtttttactacggttactaacgtttaccggtaacttaacgttttagaacgttaacggtcttacgttaggtacggtacgttacgggtcgtttacgggtacccggggg

SEQ ID NO: 340248 - DNA, 718 bp, Homo sapiens
  misc_feature: GZ8MTXP02F66BL.17.10.A10.1.454.CMB.2.raw
  modified_base (257)..(257): a, c, t, g, unknown or other
  misc_feature (257)..(257): n is a, c, g, or t
  modified_base (559)..(559): a, c, t, g, unknown or other
  misc_feature (559)..(559): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntaggtatgaagttggggtgacgacgacggcccccggagaagggctttggaggtggggtgggggtggtcgaggtcggtcgtttgggacggtaagggcaacgagtagtgacccaaccggaagacgtagggaaagggccaaggtacgtaccaacggtacttacccgaaccgggaacccaaacccccgaacgaaaccacgacgttacctaacaacttcgaaccaacgttaggaacgacgtacccgtaggaagaacggccgttaacggaccgaaccgtaccggggtaccgttacgtaactttacggnggttacgacggtaaagtaaacgtttcggttttacacggttactaacgtttaacccggttaaacttaaaacgtttaggtaaacgtttacgggaaccctttaagtaacggttacggggttacgtttaacggggtacccgtttacgggggtaacccgggggg

SEQ ID NO: 340249 - DNA, 652 bp, Homo sapiens
  misc_feature: GZ8MTXP02GJTOJ.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcacaaaatatggtatgaagttgggtgcgacgacggaccccccggaagaaaggcgtttaggaggtggggtaggggtggggtccgaggtcggtcgtttaggacgggttaagggcgtaaccgaaggtaagtggaccccgaaaccggaaagaagtagggaaaggggaccaagggaggtccgaaacggtaactttaaccccgaaccggaacccaaccccccaacgaaaccaacacgtacctaacatacgacaaacgtgaaccgagaccagaagagcgtagacgacgaccgggcctacctattacgtcgtagcgaagtatttcggtttctaggtacctagttacgttaactaagtttagattaaggccttacgtagtacggacgtacggtacgtttcggtaccggggg

SEQ ID NO: 340250 - DNA, 632 bp, Homo sapiens
  misc_feature: GZ8MTXP02JMBXU.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccggagaagggcttggaggtggggtggggtgggtcgaggcggtcgtttggacggtaaggcacgagtagtgacccaccgaagagtaggaagggcagagtcgacgacttaccgacggaccacccccgagaaaccacagtctacatgacaacgtgaacgagacccgtagaacgacgcgtacggaaccgaccgtaccgggtacccgttacgttaacgttaccgttggtacggaccggtaagtaaactttcggtttttaccgtaggttacctaagttaccggttaaacttaagttttacgagttaacggtctacgttagtcgggaacttcggtaaccgtttcggtaccggggg

SEQ ID NO: 340251 - DNA, 702 bp, Homo sapiens
  misc_feature: GZ8MTXP02HB2YM.17.10.A10.1.454.CMB.2.raw
  modified_base (472)..(472): a, c, t, g, unknown or other
  misc_feature (472)..(472): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatagaagttgggtgcgacgacggcccccggagaaggggctttggagggtggggtggggtggggtcgaggtcggtcgtttaggacggtaaggccagagtagtgacccgaccgaagagtaggaagggcgaagacgtcaacggtacttacccgaccggaaccaaccccccaacgaaaccacgaacggtactaacacgtacgactaaacgnggaaacggacgacccgtagggaaacgacgcgtacgaacccggacgaacccggggtcccttaaccgttaaagtttccggtaggtcggtaccggtaaggtaaagtttacggttttctacggttacttaccgttaacggtaacctttaaaacgtttcgtaaaggtttacggaacctttacgtaaaggttcgggtaaactttcgggggttaacctttccgggttaaccgggggg

SEQ ID NO: 340252 - DNA, 656 bp, Homo sapiens
  misc_feature: GZ8MTXP02JEWTV.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacaacaaaatatggtatgtaagttgggtgcgacgacggcccccggagaagggcttggaggtggggtggggtgggtcgaggcggtcgtttggacggtaaggcacgagtatgaccgaccgaagactaggaaggcgagcgtacgaacgtaacttacccgaaccgggacccaacccccgaacgaaaccacgacgtactaacgatacgactaacgtacgaacggacgcccgtagaacggacgtacgtacggaaccgaccgaccgggtacccgtacgttactttacgtcgtaggaccgtaagtaagtttcggttttacgtcgttactaacgttaccgttaacgttaagtttacggtattaacgggtccttacgttagtacggtacgttacggttaacgtttccgggtacggggg

SEQ ID NO: 340253 - DNA, 601 bp, Homo sapiens
  misc_feature: GZ8MTXP02F8PA2.17.10.A10.1.454.CMB.2.raw
  modified_base (380)..(380): a, c, t, g, unknown or other
  misc_feature (380)..(380): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggacaagggcttgaggtcgggtggggtaggggtcgaggcgggtcgtttggacggtaaggcacgagtatgaccaccgaagagtaggaagggcaagngtcacgattaccacggaccacccccacgaacacagtcacatgacactagacgagccctagagacggctacgacgacaccgggcctaccgttattacgtaggttgaccgtaagtaagttcgttttactcgttactagttacgttaactaacgtttacgaagttaagggccctttacgtaagttacgggactttacgggtaccgtttacggtaacccgggggg

SEQ ID NO: 340254 - DNA, 623 bp, Homo sapiens
  misc_feature: GZ8MTXP02GFMPC.17.10.A10.1.454.CMB.2.raw
  modified_base (269)..(269): a, c, t, g, unknown or other
  misc_feature (269)..(269): n is a, c, g, or t
tcagcgtagactagcacgaccggtgctcgatttagcgtcgatctcaggggagctctgcttcagctgtgagcgcagaaggcaggactcgggacaatcttcatcatgacctgctccctctcctcctcacccttctcattcactgcacagggtcctgggcccagtctgtgttgacacacgcccgccctcagttgtctcggccggcccccggagacggacggtcaccatcttcttgcctctaccggaaaccccccatgttgattcattatgtntcctggtaccagaccaacgtcccggatccaccgaccccctaaactcctactatactatagaagtaataactaacgccgtacctacggtacgggttcccctacgaccgtacttcgtctcggctaccgagtcgtcggaccaccgtctcgacccaccgtggactcgccaccgcgacctcccgaggtacgtacgggacgacggactagtacttcgacgcagaacgagtcggattcccgagcccttaggtaccgttggtgggtttacgtacggacggtaggtaccgggaaccctaggtacccgtacgaacccggttcgtacggtaccgaccggtacccgtaacggtcccgtacccccgg

SEQ ID NO: 340255 - DNA, 600 bp, Homo sapiens
  misc_feature: GZ8MTXP02F1XA2.17.10.A10.1.454.CMB.2.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttnaacaaaatatggtatgaattgggtgcgacacggcccccgganaagggcttggaggtggggtaggggtgggtcgaggcggtcgtttggacgggtaaggcacgagtatgaccaccgaagataggaagggcagngtcaacgatacccgacggacacccccaagaaacatacgtactacatagactaactgacgagacctagaacgagctagaccgacgaccggtccgtactacgttacgtggtacgacggtaagtaaactttggttttctagttactaacttacggttaactaagttttacgaagttaaggccttacgtacgttaggtaacgtcggtacgtttcggtacggggg

SEQ ID NO: 340256 - DNA, 731 bp, Homo sapiens
  misc_feature: GZ8MTXP02H9JLX.17.10.A10.1.454.CMB.2.raw
tcagcgtagactagcacgaccggtgctcgatttagcgtcgatctcaggggacccaaaaccacacccctccttgggagaatccctagatcacagctcctcaccatggactggacctggagcatccttttcctggtggcagcaggcacgaggtgcccacgcccaggttcagttggtgcagacgtggggctggaggtgcagaagccgtggggcatcagtgactgtctctgcaaggccagtggatatatcttacaacaaaatataggtataggtaaagttggggtgacggaacgacgggaccccccggaagaaacggggtcttggagggttggggtgggggtgggtacgaggtcgggtcgtttgggaacgggttaaggcaacgtagtagtggacccgaaccgaaagagtagggaaaggggcaagggacgtacgaaacggtaacgttaacccgaaaccgggaacccaaacccccccgaaaggaaaaccaaccgaagttaccaacatcgacaaacgagaaccgacgccgtagaacgagcgtaggaaccgaacgaccgggtacccgttacgtaacgttaaccgtggttacggaccggtaagtaaagtttcgtttttaccgtagttaccgtaaagtttacccgggttaaacttaaacgttttacggtaaattacggggttaacttaccgtaaaggttcgggtaaacccgtttgggtaccgttttaacggacccgggggg

SEQ ID NO: 340257 - DNA, 595 bp, Homo sapiens
  misc_feature: GZ8MTXP02IXKLS.17.10.A10.1.454.CMB.2.raw
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcaacaaaatntaggtatgaagttgggtgcgacaccggcccccgganaagggtctttggacggtggggtggggtggtcgaggcggcgttttggacggtaaggctanagtatgccacgaagatacggaagggcaagtgtcaacggtactacccgacggaccacccccgagaaacanacgttcacattcgacactagacagccngagacgcngaccacgcggaccttcaagtttccngtacgacgtaaagttatttcgtttacgttgttactacgttacgttaacgttaacgtttacgttaacgttacgtaacgtacgttacgtacggtacgtacggtacgttacggtcggg

SEQ ID NO: 340258 - DNA, 670 bp, Homo sapiens
  misc_feature: GZ8MTXP02JVJ6E.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaacaaaatatggtaatgtaaagttgggtgcggacgacgggcccccggacgaagggtcgtttaggaggtggggtggggtgggtcgaggcggtcgtttagggaacggtaaggcacgagtgtagcccgaaccgaagagtaggaaggggcaggagtccgaacgacttacccgaaccgacccgaacccccaacggaaaccacgaacgtactaacgactcgacaacgaggaaccgacgcctaggaagacgccgtacggaaccgacgaaccggggtccctacttagttacgtaggtcggacgtaaggttaaacgtttcggtttttacctagtttacgactttaacgtaaccggttaatttacggaacgtttaacggcctttacggtagttcggaacgtttcggtaaccgtttcggtacccgggggg

SEQ ID NO: 340259 - DNA, 692 bp, Homo sapiens
  misc_feature: GZ8MTXP02HSZW3.17.10.A10.1.454.CMB.2.raw
  modified_base (276)..(276): a, c, t, g, unknown or other
  misc_feature (276)..(276): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtggatatatcttacaacaaaatatggtatgaagttgggngacgacgacggcccccggagaacgggtcttggagggtggggtggggtgggtcgaggcggtcgtttgggaacgggtaagcaacgtagtatcggacccgaacgaagtacgtaggaaagggcaaggacgtacgaacgtaacgttaaccccgacgggaacccccaacccccgaaacgaaccaacacgtactaacgagtacgactaacgtcgaaccgtacgaccgtagaggacgtacgtacggaaaccggacgtaccgggtcccgttacttaacgtttaacggtggtacggtacggtaagttaacgtttcgtttttacgtacggttaccttacgttaccggtttaaattacgtttaggtaacgttcggtcttacgtaagttacggaacgtttcgggtaaccgtttcgggggtaaccggggg

SEQ ID NO: 340260 - DNA, 674 bp, Homo sapiens
  misc_feature: GZ8MTXP02HPQ0Y.17.10.A10.1.454.CMB.2.raw
  modified_base (248)..(248): a, c, t, g, unknown or other
  misc_feature (248)..(248): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggcagtgatatatcttanaacaaaatatggtatgaagttgggtgcgacgacggcccccggagaagggcttggagggtggggtggggtgggtcgaggtcggtcgtttaggacgggtaaggcaacgtagtagtcggaccgaaccggaagtagtagggaagggacaggcgtaccgaacgtaacttacccgaaccggaacccaacccccgaacgaaaccacgacggtactaacagttacgacgaactcggaaccgacgtacccgtaggaacgacggctacggaaccgaccgaccgggtaccgtacttacttacgtgtacgacgttaagtaagtttcgttttcgtacggttctaacgtttacgttaaacgttaagtttacggtaaattacggttaaccttcgtaaaggttcgggtacgtttaccggtaacgtttcggtaacccgggggg

SEQ ID NO: 340261 - DNA, 715 bp, Homo sapiens
  misc_feature: GZ8MTXP02IFC40.17.10.A10.1.454.CMB.2.raw
  modified_base (252)..(252): a, c, t, g, unknown or other
  misc_feature (252)..(252): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcggccggcccccggacaggacggtcaccatctctgctctacgaacccccatgtgatcatngtgtctgtacagcacgtccggatcacgaccccaactcctacatatatagaagaataaataacgaccgtacccctcggtacgggttccccgtacgtacccgtacttcctcgttcggcctccgtaagttctcggcctaccgtctcgaccccgacccgttcgggcctaacgtcccgacccggccctaccgtacccgtacggtacggtcgggggaccggtacgggtacccggtacggtttacgtttccgtggaccgtaccgtaaaccgttggtaaccgggttactttacccgaacggttcccgtacggttaacccgttttcggggtttcgggggttacggtttaccggggacgttaaacggggttaccggggaaacccgtaacggttccgtaccgggtaaccccgttccggttaacccggtaccgtaaccggtacccccggaacgggttaccccgttaccccccggg

SEQ ID NO: 340262 - DNA, 704 bp, Homo sapiens
  misc_feature: GZ8MTXP02JYD3O.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacaacaaaatatggtatgaagttgggtgcgacgacggcccccggagaacgggcttggaggtggggtggggtgggtcgaggcggtcgtttaggacgggtaaggcgacgtagtacgtgacccgaaccgaaggagtaggaaaggggcgaagggacgggttaccgaaaccggtaacttaaccccgaaccgggaaccccaaaccccccgaacgaaaccacctaacggtacctaacgactacggaccaacgtacggaacgtacgccgtagacggacgacgtacggaaccgaaccgacccgggtacccgttacttacgtttaccgtgggtacgacggtaagttaaagtttcgttttacgtacggttactaacgtttacccgttaaactttaagtttacgtaacgtttacggtcgttaacgttacgtgggttaacctcgggttaccgtttacggtcccgggggg

SEQ ID NO: 340263 - DNA, 569 bp, Homo sapiens
  misc_feature: GZ8MTXP02IL28G.17.10.A10.1.454.CMB.2.raw
  modified_base (248)..(248): a, c, t, g, unknown or other
  misc_feature (248)..(248): n is a, c, g, or t
  modified_base (487)..(487): a, c, t, g, unknown or other
  misc_feature (487)..(487): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaatccgtggggcatcagtgactgtctcctgcaaggccagtgatatatcttnacaaaatatggtatgaattgggtgcgacacggcccccggacgaagggcttggaggtggggtgggggtgggtcgaggtcgggtcgtttgggacgggtaaggccaacgagtatgccaccgaagatggaagggcagagtcacgaacttaccacggaccacccccaagaaacacgagtacctacatgacaactagacgagacctgaagacgcgtagacgaccgacgggtccgtcgtattacgngtgcgaagtacgtgtttctgtcagttacgtactagtttagagttagcctagtacgtaggtactggtaccgttcgtacggggg

SEQ ID NO: 340264 - DNA, 611 bp, Homo sapiens
  misc_feature: GZ8MTXP02ILQH8.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntggtatgaattgggtgcgacgacggcccccggagaagggcttggaggtggggtggggtgggtcgaggcggtcgtttggacggtaggcagagtatgaccaccgaagagtaggaagggcagagtcaacgacttacccgaccggaaccacccccgaacgaaaccacgacgtctaacgatcgacaacgtgacgagccgtagagacgctagaccgacgacgggccctacgtattacgtgtcggacgtaagtatttcggttttactaggttacctacgtttacgtaaacgttagttttacgagtttacggaactttaccgtagttacggtaccgttacggtaccgtttcggtaccggggg

SEQ ID NO: 340265 - DNA, 566 bp, Homo sapiens
  misc_feature: GZ8MTXP02HEEUJ.17.10.A10.1.454.CMB.2.raw
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (349)..(349): a, c, t, g, unknown or other
  misc_feature (349)..(349): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacaacaaaatgtaggtatgaattgggtncganaggcaccggacaagggcttggaggtggggtggggtggtcaggcggtctttggacggtaggcacgagtancgacaaccgaagataggaaaggggcagggagtacaacggtactaaccacgggaccacccccgaagaaccacgacgtactacagtgacaaactcgaacgagcctaggacgacgctagaccgacgaccggcctacgtattacgnggtntacgagtacttgttctgtactatcgtaactagttgactaaggtctagttactggtacgtcggtacttcggg

SEQ ID NO: 340266 - DNA, 765 bp, Homo sapiens
  misc_feature: GZ8MTXP02IDCZF.17.10.A10.1.454.CMB.2.raw
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatagtaattgggtgcgacncggacccccgganaagggcttggaggtggggtggggtgggtcgaggcggtcgtttaggacgggtaaggctacgagtagtcgaccaaccggaaagagtagggaaaggggacaaggtagtaccgaacggtaacttaacccgaaccggggaccccaaaccccccgaacgaaacccaacgaacggttacctaaccaagtacggacctaaacgtacggaaacccgaacggcccgtagggaaacggacggtacccgttacggggaaaccccgaaccggtacccggggtacccccgtttacttaaaccgttttaaccgtcggggttaggtaaccggtaagggttaaaagtttcgggttttttaccgtacgggtttaccaaacgttttacccggttaaaactttaacgttttacggtaagttaacggggtcctttacgtaagtttacggggtaaccgtttacgggttaaccgttttccggtaacccgggggg

SEQ ID NO: 340267 - DNA, 665 bp, Homo sapiens
  misc_feature: GZ8MTXP02G99P6.17.10.A10.1.454.CMB.2.raw
  modified_base (293)..(293): a, c, t, g, unknown or other
  misc_feature (293)..(293): n is a, c, g, or t
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcacaaaatatggtatgaattggggtgcgacgacggcccccgganaagggcttggaggtggggtggggtgggtcgaggcggcgtttggacggtaaggcacagtatgaccaccgaagagtaggaaggcagngtcacgattaccacggaccaccccacgaacacagtcacatcgacaactgacgacgaccgtgaagtacgccgtacggaaccgaccgaccggggtacccgttacgttaacgttaccgttacggtacggaccggtaaagtaaacgtttcggtttttacctacggtttacctaacgttaccggttaaaaccttaagtttttacggaaacgtttaacggggtaacctttaacggttaacgttacggggtaaaccgttacggggttaacccgtttccgggtaacccggggggg

SEQ ID NO: 340268 - DNA, 597 bp, Homo sapiens
  misc_feature: GZ8MTXP02FP03H.17.10.A10.1.454.CMB.2.raw
  modified_base (288)..(288): a, c, t, g, unknown or other
  misc_feature (288)..(288): n is a, c, g, or t
  modified_base (377)..(377): a, c, t, g, unknown or other
  misc_feature (377)..(377): n is a, c, g, or t
  modified_base (436)..(436): a, c, t, g, unknown or other
  misc_feature (436)..(436): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttggaggtggggtggggtgggtcgaggcggtctttggacgggtaaggcacgagtagtgcccaacctaagataggaagggcagngtcaacgattacccgacggaccacccccacgaacacagtacaacatgacaactgaacgngacctgagagctagacgacgacggcccgtactagttactgtagcggtaagtaagtttcgttttctggttactaacgtttacgtaaaccttaaaagtttttcgagtttaaagggtcctttacgtaaagtcggggtaacttgggtaccgtttcggtacggggg

SEQ ID NO: 340269 - DNA, 783 bp, Homo sapiens
  misc_feature: GZ8MTXP02IOA5E.17.10.A10.1.454.CMB.2.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcaggtgactgtctcctgcgaaggccagtgatatatctacaacaaatntaggtatgtaagttgggtgacgacgaccggcccccggaagaacgggtcgttggaggggttggggtagggggtgggtacgaggtcgggtcgttttaggggaacggggttaaggcgaaacgtaaggtacgtacggaccccgaaaccgggaagtagtaggggaaacggggtaccaagggtacggttaccgaaacggttaaccgttaaccccggaaacccggggacccccaaacccccccgtaaacggaaacccgaccgaacggtttaaccctaaccgagttacccggaacctaaaccggttacggaaaccggacgcccgtaggaacgaccgtacgtaccggaaccgaacgtacccgggtaccgttacttaacgttcgttaggcgtaaacggtaagttaacgtttcggttttctacggttacgtaacttacccggttaaactttagtttacgaaacggttcggtaacccgtttagtacggttacgggtaaccgttcggtttaacccggttttcggggaacccggggg

SEQ ID NO: 340270 - DNA, 634 bp, Homo sapiens
  misc_feature: GZ8MTXP02FSNFM.17.10.A10.1.454.CMB.2.raw
  modified_base (262)..(262): a, c, t, g, unknown or other
  misc_feature (262)..(262): n is a, c, g, or t
  modified_base (564)..(564): a, c, t, g, unknown or other
  misc_feature (564)..(564): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcgaaggccagtgatatatcttacaactaaaatntaggtatagaagttgggtgcgacgacggcccccggagaagggctttaggagggttggggtggggtgggtcgaggcggtgtttagggacgggtaaggcacgagtatgacccaacgaagagtaggaaggcaaggagtccaacggtaacttaacccgaccggaacccaacccccgaaagaaacactaacgtctaaacgatacgacaaacgtacggaaccgtcgaccgtagaacggagaccgtagaaccgacccgacgggtacccttacgtattacgtggtacgacgtaagtactttcgttttacngtactagtaccgttaattacgttgaacgtaggtcttcgtaagtcggtactacgtcgttcggtaccggggg

SEQ ID NO: 340271 - DNA, 592 bp, Homo sapiens
  misc_feature: GZ8MTXP02I9RDU.17.10.A10.1.454.CMB.2.raw
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccggacgaagggcttggaggtggggtggggtggggtcgaggtcggtcgtttggacggtaaggcaacgagtatgccaccgaagataggaggcagngtcacgataccgacggaccacccccagaaacacacgtactacatcgacaaccgtgaacgacgaccgtagagagtcgagaccgacgaccgggccgtactagttacgtgtacgcgaagtaacttcggttttactggttacctaggttacgtaacttaagttttacgaagttacggcttacgtaagttcggtacttcggtactttcggtaccggggg

SEQ ID NO: 340272 - DNA, 582 bp, Homo sapiens
  misc_feature: GZ8MTXP02I8ZTQ.17.10.A10.1.454.CMB.2.raw
  modified_base (377)..(377): a, c, t, g, unknown or other
  misc_feature (377)..(377): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacgaagggcttgaggtggggtggggtggtcgaggcggtcgtttggacgggtaaggccaacgagtatgccaccgaagagtagaagggcagngtcacgtattaccgacggaccaacccccagaaaccacagtctacatgacaactgacgagccgtagagacgctacggacgacgaccgggccgtctagtactggtcgcgtaagtattgttttactgttactagttaccgtaacttaagtttacggattaggccttacgttaacgtcggtacttcgggtaactttcgggtaccggggg

SEQ ID NO: 340273 - DNA, 579 bp, Homo sapiens
  misc_feature: GZ8MTXP02H2V47.17.10.A10.1.454.CMB.2.raw
  modified_base (291)..(291): a, c, t, g, unknown or other
  misc_feature (291)..(291): n is a, c, g, or t
  modified_base (558)..(558): a, c, t, g, unknown or other
  misc_feature (558)..(558): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatgaattgggtgcgacacggcccccgganaagggcttggaggtggggtggggtgggtcgaggcggtctttggacggttaaggcaacgagtatgccaccgaagatggaaaggggcaggagtcgaacgtacttaacccgaacggaccaaccccccaaggaaaccacagtcctaacgatgacaaactgaaacgagcctagagaagcctagaccgaacaccgggcccgtataacttactggtgcgaagtaaacttgtttttccagtttcaattccgtaactaatttcgaataggctatanggtacttggactttcgcgggg

SEQ ID NO: 340274 - DNA, 755 bp, Homo sapiens
  misc_feature: GZ8MTXP02H92U5.17.10.A10.1.454.CMB.2.raw
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggccagtgatatatctacaacaaaatntggtatagtaagttgggtagcgacgacgggacccccggaagaaggggtcttgggaggggttgggggtgggggtgggttcgaggtccgggtacgttttagggaaaccggggttaaggcgtaaacgtaggtagtacggacccgaaaccggaaaggtagaggggaaaacgggcgaaggtacggtaccgaaacgtaacgttaaacccccggaacccggaaccccaaccccccgaaacggaaacccacgaacgttacctaacagtccgaacgaaacgtcggaacgacgaccgtagaacggacgtacgaggaaaccggaaccgtaccgggtacccgttacttaacgtttaaccgtggtacggtaactaagggtttaaactttcggtttttacaggttactaacgtttaccggttaaattaaacgttttgaaaccgtttagggtaacccttttaagaacggtttacggtaacgtttcggtaccggttttaacgggcccgggggg

SEQ ID NO: 340275 - DNA, 674 bp, Homo sapiens
  misc_feature: GZ8MTXP02GNU7W.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcaggttggtgcagacgtggggctggaggtgcagaagccgtggggcatcagtgactgtctcctgcaaggcaggtgatatatcttacaacaaaatatggtatgaagttgggtgcgacgacggcccccggaagaagggcttggagggtggggtggggtgggtcgaggcggtcgtttaggacggtaaggcacgagtatcgaccgtaaccgaagagtaggaagggcaaggcgtcaacggtacttaaccccgaacggaacccaacccccgaagaaaccacgaacgtcctaacattacgactaaaccgtacgacgacgtacgtagaaaggcgacgtacggaaccgaccgaccgggtccgtacgttaatttacgtggtacgacggtaagttaacgtttcggttttcgtacggttaactacttaccggtttaaacgtacgttttagaacggtttacgcgttttacttaacgggttacggtaacggtttcggtaaccggttttccggggtaacggggg

SEQ ID NO: 340276 - DNA, 654 bp, Homo sapiens
  misc_feature: GZ8MTXP02GLTBA.17.10.A10.1.454.CMB.2.raw
  modified_base (261)..(261): a, c, t, g, unknown or other
  misc_feature (261)..(261): n is a, c, g, or t
  modified_base (533)..(533): a, c, t, g, unknown or other
  misc_feature (533)..(533): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcaggttggtgcagactggggctggaggtgcagaagccgtggggcatcagtgactgtctcctgcaaggccagtgatatatcttacaactaaaatntagtatgaagttgggtgcgacgcggacccccggagaagggtctaggagggtggggtggggtgggtcgaggtcggtcgtttgggacgggtaggcacgagtatcgcccgacggaagagtaggaaggcaaggacgtacgaacgtacttaacccgaaccgggaccaacccccgaacgaaaccacacgtacctaacatttaccaaacgtcgaacgcgaccgtagaacgacgcctagggaccgaacgaccgggtcccggtttactaacgtttaaccgnggtacgtaacggtaagttatttggttttcctaggtactacgttacgttaaacgtgtttacgaacttggtccttaagtacggtacggtacgttaggtaccgtttcgggacggggtaacccgg

SEQ ID NO: 340277 - DNA, 656 bp, Homo sapiens
  misc_feature: GZ8MTXP02JRPWM.17.10.A10.1.454.CMB.2.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatctacaacaaatngtatgtaagttgggncgacgacggccccggagaggtctggaggtggggtggggtggtcgaggcggtgtttagggacggtaggcaagtagtatggaccgaccgaagatagggaaggcgaagggcgtacgaagtaccgttaaccgaaccggaccccaacccccgaaacgaaaccgacgtacgtacctacgacgtacgaccaacgtacggaacgtacgccgtaaggacgtacgacgtacggaaccgaccgtaccggggtacccttacgttaacgttacgtgtacggtacgtaagttaacgtttcgttttacgtacgtactacgttaccgttaaacttagttagtaacgtacggtcgttacgtaacgtcggttaacgtacgggttacgtttacgggccggggg

SEQ ID NO: 340278 - DNA, 698 bp, Homo sapiens
  misc_feature: GZ8MTXP02IUVUB.17.10.A10.1.454.CMB.2.raw
  modified_base (278)..(278): a, c, t, g, unknown or other
  misc_feature (278)..(278): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaggccaggtggatatatcttcaactaaaatatggtatgtaagttgggngcgacgacggcccccggacgaacgggtcttggagggttggggtggggtggtacgaggcgggtgtttacgggacgggtaaggcgacgtagtagtcgacccgaaccggtaagagtaggggaagggacgaagtacggtccgaaacggtaaacgttaccccgaaccggaaccccaaaccccccgaacggaaaccaaccgtacgtaccgtaacaagtacgacctaaaccgtacggaaccgaacgcccgtaggaaacgacggtaccgaacggaaccgaccgggaccggggtaccctacgttacgtttaacgcggtacgacggtaagttaagtttcgttttactggttacctagttacgttaaactacgtttagtaagtacggtcttacgtagtacggtacgttacggtaccgttcggtaccggggg

SEQ ID NO: 340279 - DNA, 543 bp, Homo sapiens
  misc_feature: GZ8MTXP02FFAE4.17.10.A10.1.454.CMB.2.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (483)..(483): a, c, t, g, unknown or other
  misc_feature (483)..(483): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatatggtatgaattggggtgcgacacggacccccggacgaagggctttgaggtggggtggggtgggtcgaggcggcgtttgacggtaaggcacagtatgccaccgaagatggaagggcagngtcacgattaccgacgacacccccaagaaacacagtctaacatgcaactgaacgngccngagngcngacgacacgggctactattactgtgacgagtaagtgttttacngtcacttcgtaactatttacgattaggcttactagtcggtactggactttcggacggggg

SEQ ID NO: 340280 - DNA, 637 bp, Homo sapiens
  misc_feature: GZ8MTXP02HQCS4.17.10.A10.1.454.CMB.2.raw
  modified_base (335)..(335): a, c, t, g, unknown or other
  misc_feature (335)..(335): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggcagtgatatatcttacaacaaaatgtggtatgtaagttgggtgcgacacgggcccccggaagaacgggtcttggaggtggggtggggtggtcaggcggtntttgggacggtagcacgagtatcgcccaacgagagtaggaagggcaaggacgtcaacgtacgttacccgaacggaaccccaccccgaacgaaacacgacgtacaacgatcgactaacgacgacgagtaccgaggacacggtcctaacggacgaaccgtccgggtaccgttactacgttaacgttggacgtaccgtaagttaattcggttttctacggttctacgttacgttaacttacgtttagacgttacggtaacttacgtaggttacggacgtttcggtaacgtttcggaacccggggg

SEQ ID NO: 340281 - DNA, 622 bp, Homo sapiens
  misc_feature: GZ8MTXP02JS8ZA.17.10.A10.1.454.CMB.2.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcgccggcccccggacaggacggtcaccatctcttcgctctacggaacccccatgtgatcatangtgtctgtaccngcaacgtccggatccaccgaccccaaactccctcaatactatagaaagtataaataacgaccgtacccgtcgtacggggttccccctcgtaaccgtacttcctcgtcggtaccttccgtaaacgtctcgggtaccacgttcgtccgcccgtaacccgtcgggactacctccgacccgtccgacctcccgaggaccggtacggggacggacggtaccggagttacgtttcgagaccgacgaaacgtgtacgggacttccgacgcctgtacgtcggtcgggtgtccgagtcggtacggtaccgacgtcgtacgcccgtacgtaaccggttcgacggtcccgaacggtccgtccccgg

SEQ ID NO: 340282 - DNA, 641 bp, Homo sapiens
  misc_feature: GZ8MTXP02J2IW2.17.10.A10.1.454.CMB.2.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (531)..(531): a, c, t, g, unknown or other
  misc_feature (531)..(531): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactgggctgaggtgcagaagccgtggggcatcagtgactgtctcctgcaaggccagtgatatatcttacaacaaaatntggtatgaagttgggnacgacgacggcccccggaagaagggtcttaggaggttggggtggggtaggtcgaggtcggtcgtttagggacggttaaggctacgagtagtcgacccgaaccgaagagtacggaagggcaaggacgtcaacgtactaccgacggacccaaccccgaacgtaaacactacgtacctaacgatcggacctaacgtacggaacgacgaccgtagaacgacgtcacggacgtaacgaccgggtccgtacttagtttaccggnggtacgagtaagtacgtttcgtttacgtacgttactacgttacgttaacttacgttacgaacgttacgtcgttacgtacgtacggtacgttcggttacgtcgggtacggg

SEQ ID NO: 340283 - DNA, 673 bp, Homo sapiens
  misc_feature: GZ8MTXP02F7CWZ.17.10.A10.1.454.CMB.2.raw
  modified_base (251)..(251): a, c, t, g, unknown or other
  misc_feature (251)..(251): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttanaacaaaatatgtatagaattgggtgcgacacggcccccggaacgaagggctttggagggtgggggtggggtgggtcaggtcgggtctttgggaacggtaggcacgaggtatgaccgtaaccgaagagtaggaagggcaagcggtacaaacgacttacccgaacggaacccaacccccgaacaaaccactagtaccaacatacgacaactacggaccgagtaccgagaacgaacggccgtaacggaccgaccgtaaccgggtccgtaccttaagttaccgtaggtacgacggtaagtaaagtttccggttttatcgtttactacgttaacccggttaaacttaacgttttacgtaagttacgggtccttacgttaagtacgggtaacgtttacgggtaacccgtttcgggtaaacccgggggg

SEQ ID NO: 340284 - DNA, 644 bp, Homo sapiens
  misc_feature: GZ8MTXP02JLBJB.17.10.A10.1.454.CMB.2.raw
  modified_base (398)..(398): a, c, t, g, unknown or other
  misc_feature (398)..(398): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatagaagttgggtagcgacgacggacccccggacgaagggcttaggagggttggggtggggtagggtcgaggtcggtcgtttgggacgggtaaggcaacgagtatgaccgaccgaagactaggaagggcaaggngtcaacgtacgttaccacggacccacccccgacgaaaccacacgtacacatgacaactacgaacgacgaccgtagaacgagacgtacggaaccgacgaccgggtacccgtacttacgttacgttggtacggacgtaaggtaacttcggttttacgttacggtctaacggtacttaaacgttaagtttacgtagttacggtcgttaccgtaagtacggtacgtacggtaccgttcggtaaccggggg

SEQ ID NO: 340285 - DNA, 634 bp, Homo sapiens
  misc_feature: GZ8MTXP02GJ3K7.17.10.A10.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (570)..(570): a, c, t, g, unknown or other
  misc_feature (570)..(570): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnaacaaaatntggtatgaattgggtgcgacacggccccgagaaggctgaggtggggtggggtggtcgagcggtcgtttggacggtaagggcacgagtagtacgccgaaccgaagatagggaagggacgaagtacggtacaacggtaacttaaccccgaaccgggaacccaaaccccccgaaaccggaaaccacgtaacgtacgtaaccaagtcgaacaaaccgtgaaccgacgtaccgtggaaacgacgtacgtacggaccgaaccgaccggggtcctaacgttaacttacgttcggacgtacgaagtaatttcggttttacnggttactacgtacgttaactatttacggataggtcctatagtcgagtcgtacgttcgacggggg

SEQ ID NO: 340286 - DNA, 668 bp, Homo sapiens
  misc_feature: GZ8MTXP02JVQJD.17.10.A10.1.454.CMB.2.raw
  modified_base (254)..(254): a, c, t, g, unknown or other
  misc_feature (254)..(254): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaatntgtatgaattgggtgcgacgacgggacccccggagaacgggtcttggacgggttggggtggggtgggcgtaggcgggtcgttttagggacggtaaaggcgaacgagtatgaccgaccgaagatagggaagggcaggtcgtacgaacgtaacgttaccgaaccggacccacccccgaacggaaacctaacgagtacctaacatcgacgaaactggaaaccgacgcctagagaacgcgtacggacgaccgaccgggtaccgttacctagttttaacccggtggtacgtacgtaagttaacgtttcggttttaccgtagttaccgtacgttaacggttaacgtaagtttacgtaacgttacgggtaaccttacgtacggttacggtacgttcgggtaccggtttacgggtacggggg

SEQ ID NO: 340287 - DNA, 708 bp, Homo sapiens
  misc_feature: GZ8MTXP02HSYDZ.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctccttacccttctcattcactgcacagggtcctgggcccagtctgtgttgacacacgccgccctcagtgtctcggcccggccccgagaggacggtcaccatctcttcgctcgtaccgaaccccctatgtgtatactaattagtgtcgtccgtacggtaccacgaccaaccgtcccggactaccgacccgaaccccctaaactcctacaatactatagaaataataaactaacgacccgacccgtacggtacggttaccaccgtaccgtacttctcgtcgtacctacgtacgttcgtacgacctacccgtccgttcccgaccccttacccggtcgggacctacgtcccgacccggtccaccgttacccggaggtacccgggtaggggaaccggtacgggtacccgtaagtttccgtttacgacgggtccaaacgtaccggtagtacggggtaaccctcgaccgttcgtaccggttccgtttgggggtcgggttcgtaccggggtacgacgggttaaccgggacctaaggtcccgttaggacccgtaacgtacgtaccgacggaccgtaccgtcgttacccgtcccccg

SEQ ID NO: 340288 - DNA, 632 bp, Homo sapiens
  misc_feature: GZ8MTXP02H67O0.17.10.A10.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctctgcaaggcagtgatatntctanaataaatatgtangtaagtggngcgacgacggccccgganaggtctggaggtgggtggggtggtcgaggtcggtcgtttgggacggtaggcagtagtagtcgccgaaccgtaagagtaggaaggcagtagaccgaacgtaccgttaacccgaacccggaccccaaacccccgaacgaaacccacgaacgtacctaacgacgtacgaaccaaccgtagaccgacgtcgaagcgagccgtacgacgaccgacgtccgtacttacgtacgtgtacgacgtagttaactttgtttaccgtggttactaacgttacgtaacgtttaacgttacgtaagttacggtaacttgttaaacgtcggtaacgtcggttaccgtttacggtccgggg

SEQ ID NO: 340289 - DNA, 737 bp, Homo sapiens
  misc_feature: GZ8MTXP02F1VEE.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatcttacaactaaatgtgtatgaagttgggtcacgacacgggacccccggagaaggtcttaggagggtggggtggggtacggtcgaggtcggtacggtttagggacgggtaaggcctaagagtacgtacgaccgtaaccgaagtagagggaacgggcaagggtgtaccgaacgtacgttaaccgaccgggaaacccacccccgaagaaaccacgtactacctacgaagtagacctaaacgtcgaacggacgaccgtagaaacgcggtacacgggaacgacccggtacccggggtaccttacccgttaaagttccgtagggtacggtaaccggttaaacgttaaggtttcgtttttacgtaacgggttacctttaaacggtaaaccgtttaaagtttaaccggtttaagtaccggttaaccggttaactttaaccgttaaggttacgggttacggtttaccgggttaacccggttttacgggggtaaccccggggg

SEQ ID NO: 340290 - DNA, 664 bp, Homo sapiens
  misc_feature: GZ8MTXP02HE9Y1.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatgtaagttgggtgcgacacggcccccggagaacgggtcttggagggtggggtggggtgggtcgaggcggtctttgggacggtaaggcaacgagtagtcgaccgaaccgaagagtaggaagggcaaggagtcaacgacttaccgacggacccacccccgaagaaccacacgtactacgatacgacaactgaacgacgacctagaacgacgactacggaaccgaccgaccgggtacccgttacgttacttacgttacggtacggaccgtaagtttaaagttcgtttttcgttaggttacctacgtttaccggttaacttaaacgttttcgtaaagttacggtcctttacgtaggttacgggtaccgtttacggtacccgttttacgggtaccccgggggg

SEQ ID NO: 340291 - DNA, 690 bp, Homo sapiens
  misc_feature: GZ8MTXP02JG8RD.17.10.A10.1.454.CMB.2.raw
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaanaaatatggtatgaagttgggtgcganaggctaccggagagggcttggaggtggggtggggtggtcgaggcggtcgttttaggacgggttaaacggcgtaacgtagtagtccggaccgaaccggaaagagtaggaaaggggcaggacgtacaacggtaacttaccgaaccggacccaacccccgaacgaacaaccgagtactaacacgtacgaccaaacgtacgacgacgtccgtaggaggaacgtcctacggaaccgaaccggtaccgggtaccccgttacttaaccgtttaccgtaggtaccgggacgtaagtaaagtttcggtttttaccgtggtttaaccctaagtttacccgtttaaacttaagttttacgtaagttaacggtactttaccgtaggttacgggtaccgttacgggtacccgttttccggggg

SEQ ID NO: 340292 - DNA, 647 bp, Homo sapiens
  misc_feature: GZ8MTXP02FX9PK.17.10.A10.1.454.CMB.2.raw
  modified_base (261)..(261): a, c, t, g, unknown or other
  misc_feature (261)..(261): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgcaaggccagtgatatatcttacaacaaaatntggtatgtaagttgggtgacgacgacggcccccggaagaagggcttggagggtggggtggggtggtcaggcggtcgtttaggacggtagtcacgagtagtcgacccgaacgaagagtagggaacgggacaggcgtacaacgtataacccgacggaacccaccccaagtaaaccacgacgtactaaccagtcgacaacgtagaacgagaccgtggaagacgtacgacggaacgaccgaccgggtaccttacgttagttaccgtggtacgtacggtaaagtagtttacgtttcgtacggttacttactaccggttaaacttaacgttttagaacgtttaggaactttacgtaagttcggtaacgttcggtacgttcgggtaccggggg

SEQ ID NO: 340293 - DNA, 614 bp, Homo sapiens
  misc_feature: GZ8MTXP02JNXWD.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatgaattgggtgcgacgacggcccccggagaaggctgaggtggggtggggtgggtcgaggcggtcgtttggacggtaaggcacgagtagtgaccgaccgaagagtaggaagggcagagtcaacgacttaccgacggaccacccccacgaacacagtctacatgacacgtagaacgacgccgagagaacgcgtagaccgacgaccgggaccgtactacttacgtcgtcgacgtaagtaagttcgttttacgtacggttactacgttaccgtaacgttacgtttacggtaattacgggtaacttacgttaacgttaggtaacgttcggttaccgtttacggtacccggggg

SEQ ID NO: 340294 - DNA, 646 bp, Homo sapiens
  misc_feature: GZ8MTXP02HY87X.17.10.A10.1.454.CMB.2.raw
  modified_base (449)..(449): a, c, t, g, unknown or other
  misc_feature (449)..(449): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgacaaggccagtggtatattatcttacaacaaaattataggtatagtaagttgggtgacgacgaccgggacccccggaagaacgggcgttaggacgggtcggggcggggtgggtacgaggtcggtcggtttagtacggagaccagacgtagtcgacccgacgaagagaggagggacaggtagacgacgtacttaccgacggacccacccagaaccagaaccnctacatacgacacgacgacgacgacgagagacgacgtacggacgaccgaccgtaccgtacgttacgtagtacgtcgtaggtagtacgtttcgtttacgttacgttacgttacgttacgttaacgttacgttacgttacgttacgtaacgttacgttacgttacggtacggttacggttaccggtttacgggtacggg

SEQ ID NO: 340295 - DNA, 654 bp, Homo sapiens
  misc_feature: GZ8MTXP02I1TVL.17.10.A10.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggcagtgatatatcttacaanaaatntggtatgaattgggtgcgacgacggaccccggagagggcttggaggtggggtggggtgggtcaggcggtcgtttaggacggtaggcacgtagtatgaccgacgaagacgtagaaggggcagcgtacaacgactacccgaccggaacccaacccccgaagaaaccacacgtacaacgactcgacaacgtcggaacgacgtaccaggacgtacgacgtacggaccgaaccggacgggacccttacgttacgttaacgtgggtacggacgtaacgttaactttcggtttttaccgtagttaccttacgtttaaccgtaaactttaagtttacggtaacgtttacggaaccgtttgtaaagttcggtacgttacgggttaccgtttacgggtaccggggg

SEQ ID NO: 340296 - DNA, 674 bp, Homo sapiens
  misc_feature: GZ8MTXP02FK2PS.17.10.A10.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctcctgcaaggccagtggatatatcttanaacaaaatntggtatgaagttgggtgcgacgacggcccccggacgaaggctttggaggtggggtaggggtgggtcgaggtcggtcgtttggacggtaggacacgagtagtgaccgaccgaagagtaggaagggcaaggacgtcgaacgacgttaacccgacggacccaacccccgaacgaaaccactacgtcaacactcgacaaccgtagaaccgagaccaggaagacgtacacggaaccgaaccgaccgggtacccgtacttacgttaaccgtggtacggacgtaacgtaaagtttacgtttttccgtaggttactaacgttaccggttaaacttaaacgttttacggaagtttaacggggcctttacgttaaaggtacgggtaaccgtttaggggtaacccgtttcggggtaacccggggg

SEQ ID NO: 340297 - DNA, 559 bp, Homo sapiens
  misc_feature: GZ8MTXP02FMCSE.17.10.A10.1.454.CMB.2.raw
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
  modified_base (375)..(375): a, c, t, g, unknown or other
  misc_feature (375)..(375): n is a, c, g, or t
  modified_base (492)..(492): a, c, t, g, unknown or other
  misc_feature (492)..(492): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttnacaaaatatggtatgaattgggtgcgacgaggccccccgganaagggcttgaggtggggtggggtgggtcaggcggtcgtttggacggtaaggcaacgagtatgaccaccgaagagtggaagggcagngtcaacgatacccacgacacccccagaaacacagtacaacatgacaactgaacgagcctgacgagctagacgacgaccggtcgtactattacgtgtcgacgtaagtaattgttttcngttcacgttactaactaagtttcgattaacggcgttactacgttaggactggtacgttcgtacgggg

SEQ ID NO: 340298 - DNA, 725 bp, Homo sapiens
  misc_feature: GZ8MTXP02FPTS6.17.10.A10.1.454.CMB.2.raw
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactcgtctcctgacaggcagtggatatatcttanaacgtaaaatgtaggtatgaagttgggtgacgacgaccgggacccccgganaacgggtcgttaggaggggttggggtggggtgggtcgaggtcgggtcgtttagggaacggtaaggacctagtaggtaagtcgacccgaacggaaagtaggaggaacgggcaaggtacgtacgaaacgtaacgttacccgaacccggaaacccacccccgaaacgaaacccaacgacgttacaacacgtacgaccaacgtacgacgacgaccgtaggaaggacacggtacgaacgaccgacccggggtaccttaacggtactttaaccggtggtaacggaccggtaaaagttcgtttacgtttttcgtacggttactaacgtttacccgggttaaaactttacgttttacggaagtttacggtcctttaagttacggttaccgggtacggtttacggttcccggtttacggggtaccgggggg

SEQ ID NO: 340299 - DNA, 632 bp, Homo sapiens
  misc_feature: GZ8MTXP02F5PO2.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatataggtatagtaagttgggtgcgacgacgggacccccggagaagggcttggagggttggggtggggtgggtcgaggtccgggtctttagggaacggtagggactacgagtatgaccgaaccggaagtagtagggaaagggcgaaggacggtaccaacggtacttaacccgaaccggaacccaaccccccgaagaaacacgacgtactaacgatacgacaactaggacgagacctagagacgctacggacgacgacgccgtactatacgtgtagacgtagtattcgtttctacgttacacgttaccggtaatacgtttacgagtacggtccttacgtagtaccggtagttacggtacgtttcgggtaacggggg

SEQ ID NO: 340300 - DNA, 627 bp, Homo sapiens
  misc_feature: GZ8MTXP02GXEZE.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatntggtatgtaagttgggtgacgacgacggcccccggacgaaggcttggaggttggggtgggggtggtacgaggtcggtctttcggaacggtaggcaacgaggtatcgacccgaaccgaagacgtaggaaggggcaggacgtcgaacgtacttaccgaccggaccaacccccacgaaacacacgtctaacatcgaacaacgtcgaacgacgtcctaggaacgacgccgtacgacgaccgaccggtaccgttacttaagttcctagtacgacgtaagtagtttcgtttactggtactacgttaccgttaacttacgttacgagttacggcttacgtaacgttcggacgttacggtaccgtttacgggccgggg

SEQ ID NO: 340301 - DNA, 653 bp, Homo sapiens
  misc_feature: GZ8MTXP02I72GW.17.10.A10.1.454.CMB.2.raw
  modified_base (258)..(258): a, c, t, g, unknown or other
  misc_feature (258)..(258): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatctacaacaaatntagtatgtaagttgggtgcgacgacggacccccggagaacgggctggaggttggggtaggggtgggtacgaggtcggtcgtttagggacggtaaggcaacgtagtagtcgaccgaacgaagacgtaggaagggcaaggcgtacaacggtaactaccgaggacactacccaagaacatagtactacgntacgaccaaacgtcgaaacgacgtaccgtaggaagtacgcgtaggaacccgtaaccggaccggggtacctttactaagtttccgtaggtaccggtagtaaaaggttacgttttcgtttacgtcgttaacgtacgtttaaccgttaacttaagttttacgaaagtcggtacttagtaacgtcggtacgtttacggtacgtttccggggg

SEQ ID NO: 340302 - DNA, 706 bp, Homo sapiens
  misc_feature: GZ8MTXP02JL9SK.17.10.A10.1.454.CMB.2.raw
  modified_base (259)..(259): a, c, t, g, unknown or other
  misc_feature (259)..(259): n is a, c, g, or t
tcagcgtagactagcacgaccggtgctcgatttagcgtcgatctcaggggacccaaaaaccacacccctccttgggagaatccctagatcacagctcctcaccatggactggacctggagcatccttttcctggtggcagcaggcacaggtgcccacgcccaggttcagttggtgcagacgtggggctggaggtgcaggaagccgtggggcatcgagtgactgtctctgacaaggcagtgatatatctacaataaaatntaggtatgtaagttgggtgacggacgacggacccccggagaagggtcttggagggttggggtgggggtggtcgaggtcgggtcgtttagggacgggttaacgcgaacgtagtagtcgaccgaaccggaagagtagggaaggggacaacggacgtacgaacggtaaccttaacccgaacgaccccaaaccccgaacgaaacacgtaacgtacacgactacgacaacgtacgaacgacgaccgtagacggtacgacgtacgaccgacgtaccgggtaccgttaacttacgttacggtcggtacgtacgtaaacgggtttactttcggtttttacgtacgtttacgttaacgtttaacgtaaacgttttaagttacggtaacgttacggtaaccgttacgttagggttacggacggtttaccggttccgggttacgggttaacccggggg

SEQ ID NO: 340303 - DNA, 764 bp, Homo sapiens
  misc_feature: GZ8MTXP02IGXVT.17.10.A10.1.454.CMB.2.raw
  modified_base (276)..(276): a, c, t, g, unknown or other
  misc_feature (276)..(276): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaggcagtgatatatcttacaacaaatagtagtataggaagttgggngacgacgacggacccccggagaagggtcgttaggaggggttgggggtggggtaggggtcgacgggtcgggtacgttttacgggaacgggttaaggcaacgtaagtagtcggaccccgaaccggtaaagaggttaggaaagggcgaaggacgttacgaaacgtaccgttaaacccgaaccggacccaaacccccaacgaaaccacaacgtacaacagtacgacaacgtgaccgacgaccgtagacgacgtacgtacggaaccgacccgtacgggtacccttacgtaacgtttacgtacgggtacggaaccgttagggttaaaacgttttcgtttttacgtacgtttaccgtaaacgtttaccgttaaaacgtttaacgttttaggtaaacgtttaacggggtaacctttaaccgggtttaaaacggtttaccggggttaaaccggtttaccggggtttaaccggtttacccgggggtaaacccgggggg

SEQ ID NO: 340304 - DNA, 748 bp, Homo sapiens
  misc_feature: GZ8MTXP02HEOGY.17.10.A10.1.454.CMB.2.raw
  modified_base (259)..(259): a, c, t, g, unknown or other
  misc_feature (259)..(259): n is a, c, g, or t
  modified_base (560)..(560): a, c, t, g, unknown or other
  misc_feature (560)..(560): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaactaaaatntaggtatgtaaattggggtgacggaacgaccccgggacccccggaaggaacggttgtaggtaggggtggggtgggggtcggtacgaggtcggttcgtttacgggaacggggtaggccaagtagtacgtacgacccgaacggaagtagaggggaacggacgaagggtcgtaccgaaacgttaaaccgttaaacccgaaccgaaacccccgaacccccgtaaacggaaacccaaccgttaacggtaccctaaacgtacgacggaacccttaacgacggaaccgacgtacccggaggaaacggngtaccggaacgaaccggaccgtacccgggtacccgttaacttaacgttaccgtgaacggtcggtaaaagtttgtttccggttttacggactacgtttacggtttaacctaactttaacgttagtaaccggttaacggtcttacggttaaaggttcggtacgtacggttaccgtttacggggccggggg

SEQ ID NO: 340305 - DNA, 681 bp, Homo sapiens
  misc_feature: GZ8MTXP02G7AO7.17.10.A10.1.454.CMB.2.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (397)..(397): a, c, t, g, unknown or other
  misc_feature (397)..(397): n is a, c, g, or t
  modified_base (569)..(569): a, c, t, g, unknown or other
  misc_feature (569)..(569): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtgatatatctcaanaaatntgtatgaagttgggtgcgacgacggcccccggagaagggcttggaggtggggtggggtggtccgaggtcggtcgtttagggaacgggtaaggccgaagtaggtagtagacccgaacggaaagagtagggaagggacaaggngtaccaacgtacttaacccgaacggaaccccaccccgaaacgaaacacaacggttacaacgatacgaccaacgtacgaacggaacgccgagaacggacgacgacggaacgaccggaccgggtacctaccttatacccggtgtacggaccgtagttaagttcgttttaaccgnggttacttacggttaaccttaaacgttacgtttacggtaagttacggttaacctttacgtaaggttacgggtaacgtttaccgggtccggtttacggggttaacccgggggg

SEQ ID NO: 340306 - DNA, 558 bp, Homo sapiens
  misc_feature: GZ8MTXP02GWK10.17.10.A10.1.454.CMB.2.raw
  modified_base (382)..(382): a, c, t, g, unknown or other
  misc_feature (382)..(382): n is a, c, g, or t
  modified_base (510)..(510): a, c, t, g, unknown or other
  misc_feature (510)..(510): n is a, c, g, or t
  modified_base (531)..(531): a, c, t, g, unknown or other
  misc_feature (531)..(531): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattggggtgcgacacggcccccggacaagggcttgaggtggggtggggtgggtcgaggcggcgtttggaccgggtaaggcacgagtaatgaccaccgaagataggaaggggcaaggngtcaacgacttaaccacgggaacacccccacgaaaccacagtctacatgacaaacgtgaacgagccctgaagagctacggacgacgaccgggaccgtctatttacgtgtcgcgaagaattgttttacngtcatcgtactatttgatagntctatcggactggacgttcgtacgggg

SEQ ID NO: 340307 - DNA, 801 bp, Homo sapiens
  misc_feature: GZ8MTXP02HO9NJ.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgacaaggccagtggattatatcttacaactaaaatatggtataggtaagttggggtgacgacgaccgggacccccggaagaagggtcgttggagggttggggtggggtgggtcgaggtcgggtcgtttagggaaccgggtaaggcaacgtagtatcggaccgaaaccggaagacgtaggggaaggggcaaggacgttacgaacgtaaccgttaacccgaacccggaacccccgaaaccccccgtaaacgggaaaacccaacccgtaacggttaacccttaaaccgacgttacgtaaaccgaaacccggttaggaaacccggaaccgtaccccggttaggaaaacgtcggtaaccgtacgggaacccgggtaaacccgacccggggtacccgttaacgttaaacgtttaccggtaggttacgggaccgtaaaggtttaagtttcggtttttacgacggttacctaaacgttaccgttaaaacgttaacgtttagtaaaccggtttaggaacccttttacggttaggttaacggtacggtttacggggttaaccttttcgggggaacccgggggg

SEQ ID NO: 340308 - DNA, 622 bp, Homo sapiens
  misc_feature: GZ8MTXP02IHY2M.17.10.A10.1.454.CMB.2.raw
  modified_base (559)..(559): a, c, t, g, unknown or other
  misc_feature (559)..(559): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaacaaaatatggtatgaagttgggtgcgacacggcccccggagaagggcttggaggtggggtggggtgggtcgaggcggtcgtttggacggtaaggcacgagtatgccaaccgaagataggaaaggggcaaggagtacgaacgtaactttaaccccgaaccggggaaccccaaacccccccgaacggaaaacccaaccgtaaacggtaccctaactaattacgaccaaaccgtacgaaccgaacgcccgtagacgagccgtagaacgacgaccggccgtactagttactgtgcgaagtaatgttttcngtcacttcgtactagtttgaagtaggtctacttagtcggtactcggtacgtttcggtacgggg

SEQ ID NO: 340309 - DNA, 685 bp, Homo sapiens
  misc_feature: GZ8MTXP02J2R8Z.17.10.A10.1.454.CMB.2.raw
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtcctcctgacaggccagtggatatatcttacaataaatntggtatgaagttgggncgacgacggaccccgganagggtctggagggttggggtggggtggcgaggtcggtcgtttagggacggttaggcgacgtagtagtggacccgaacggaagagtagggaagggacgaaggacgtccgaaacgtaccgtaaccgacccggaacccctaaacccccgaacgtaaacaaccgtagttacctaaacacgtacgaccgtaaacgacggaacgaacgggtcctaggaacgacgccaacgggaccgacgaccgggtacttaccgtagtttaccggtggtacgtaacggttaagttacgttttcgtttacgacgttactaacgtttacgttaacttacgttacgtaacggttacgtaacgttaacgtacggtacggttaccgttacggttaccggttcgggtacgggg

SEQ ID NO: 340310 - DNA, 668 bp, Homo sapiens
  misc_feature: GZ8MTXP02GMDQR.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggccagtgatatatcttacaacaaaatatggtatagaagttgggtgcgacgacggccccggagaagggtcttggagggtggggtggggtgggtcgaggtcggtcgtttgggaacgggtaaggcaacgtagtagtgacccgaaccggaagacgtaggaacgggacgaaggacgtaccgaacgtaacgttaccccgaaccgggaaccccaacccccgtaaacgaaaccacgtacgtacctaacgacgtagaccaacgtaggaacgtacgaccgtaggaacgacgacgtacgaccgacgaccgggtaccgtacgtacgttacgtgtacgacgtagttaagtttcgtttcgtacgtactacgttacgtaaacttacgtttacgagttacggtaacttacgtaagtacggtacgttacgggtacgtttacggaccggggg

SEQ ID NO: 340311 - DNA, 730 bp, Homo sapiens
  misc_feature: GZ8MTXP02IUXXO.17.10.A10.1.454.CMB.2.raw
  modified_base (254)..(254): a, c, t, g, unknown or other
  misc_feature (254)..(254): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctctgcaggcagtgatatatcttacaacaaaatntggtatgaagttggtgcgacacggccccggagacggcttggaggttggggtggggtgggtcgaggcggtcgtttgggaacgggtaaggccaagagtagtgaccccgaacgaagtagtagggaacggggcaggacggtacgaaacggtaacgttaccccgaacccgggaacccaaacccccccgaaacggaaaccaaccgtaacggttacccaaacagttacgaacctaaacccggtaggaaccggtaacgtccgaggaaacggtacggaccgtacgggaaacgacccgggtaccgggtaccccgttacgtttaacgtttaccgtgggttacggaccgggttaaagttaacgtttcggttttttaccgagtttaccgtacgtttaccggtaaaactttagttttacggaacgttttacggtaaccttacgttacgttacgggacgtttacggggtaccgtttcgggggacccggggg

SEQ ID NO: 340312 - DNA, 693 bp, Homo sapiens
  misc_feature: GZ8MTXP02GSYKF.17.10.A10.1.454.CMB.2.raw
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacatgtgcccacgcccaggttcagttggtgcagactggggctgaggtgcagaagccgtggggcatcagtgactgtctcctgcaaggccagtggatatatctanaacaaatgtggtatagaattgggtncgacgacggcccccgaagaagggcttggaggtggggtggggtaggtcgaggtcggtcgtttaggaacggttaaggccacgagttacgcgaccaaccggaagtagtagggaaacggcgaggacgtacaacgtacgttaacccgacggaccccaaacccccaaacgaaacctaacgaacgttacctaacaacgtacgaacctaaacgtacgaaccgacgccgtaaggaacgacgacgtacggaaccggaccgaccggtacccggttacgttaacttaaccgtggtacgtaccgtaaagtaaacgttttcggtttttacccgaggttacctaaacggttaccttaaactttaaagtttcggtaaagttaacggtaccttagttaaacggtcggtaacgtttacgggtaccctttaacggggg

SEQ ID NO: 340313 - DNA, 612 bp, Homo sapiens
  misc_feature: GZ8MTXP02I6491.17.10.A10.1.454.CMB.2.raw
  modified_base (477)..(477): a, c, t, g, unknown or other
  misc_feature (477)..(477): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcgccggcccccggacaggaggtcaccatctcttgctctcgaacccccatgtgattcaattatgtgtcctggtaccagcaacgtcccggatccacgcccccaaactcctacatataatagaaagataaataacgccgaccctcgtacggggttcccctacgtaccgtattctctcggcctcgaacgtccgtaggccaccgtctcgccccacccgtggaccactcccgaacccgccgacctacccacggtaacggtcggggaacgacggtccgtaagttactttcgngaccgacaacgagtgggacttaccgacgtcctagtaccgtttggtacggggttcgttccggacgtaggtacgggacctaacggcgtacggtaaccgtaccgtacggcgaccgtacccgaacgtcccgtaccccgg

SEQ ID NO: 340314 - DNA, 557 bp, Homo sapiens
  misc_feature: GZ8MTXP02IDY9T.17.10.A10.1.454.CMB.2.raw
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctctgcaagccagtggatatatcttcacaaaatntggtangaatggncacnggccccganagggntgaggtggngggtggtcagcggctttggacggtaaggcanagtangaccacgaagatggaagggcagngtacaacgacttaccgacgacaaccccacgaaccacgatcacaatgacaaactgacgacgaccagagagtctacgacggacacgggtcccttacgtaagttacgtgtacgagtaagtactttcgtttcttcgtactactacgtaacgtaacgttagtagtacgtaacgtacgtacgtacgtacgtacgtacgttacggtacgg

SEQ ID NO: 340315 - DNA, 724 bp, Homo sapiens
  misc_feature: GZ8MTXP02GW1M8.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaactaaaatataggtatagaagttgggtcgacgacgaccggacccccggagaagggtcgtttggagggttgggggtggggtggggtcgaggtcgggttcgtttacgggacgggttaaggcaacgtagtaagtcgaccccgaaccggaagtacgtagggaacgggcgaggagtccgaaacgtaccgttaaccgaacccgggacccaacccccccgtaaacggaaaccacgtaaacgtaccctaacgaacgtaccgacgaaacgtcggaacgacgtacccgaggacgaacgacgtacgggaccgtacccgaccgggtacccgttacgtacgtttaccgtggtacggacgtaagttaagtttcgttttacgacgtttaccgtaacgttacgttaaacgttagtttagacggttaaggttctttacgttacgggtaggttaccgttacgggtttaccgtttcggggtaacccggggg

SEQ ID NO: 340316 - DNA, 667 bp, Homo sapiens
  misc_feature: GZ8MTXP02GRV95.17.10.A10.1.454.CMB.2.raw
  modified_base (250)..(250): a, c, t, g, unknown or other
  misc_feature (250)..(250): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaggccagtgatattatttcaanaaatatggtatgtaattgggtgcgacgacggcccccggagaacgggtcttggaggtgggggtggggtggtcaggtcggtcgtttggaacgggtaaaggcgaacgtagtagtcggacaacccgtaagagtagggaaaggggcaaggatcgacgaacttaccgaccggaacccaacccccgaaacgaaccaaacgtcgtacctaaacacgttacgaccgtaaactcggaacgaacgtccgtagaacgagtaccgtacggaaccgaccgtaccgggtaccttacgttaactttacgtggtacgtacggtagttaactttcggtttaactggttacctaattcggttaaaacttagttttagaacgtggtaccttaagtaagtcggtaacgttggttaacccgttggtccgggggaaccgg

SEQ ID NO: 340317 - DNA, 559 bp, Homo sapiens
  misc_feature: GZ8MTXP02HXSXW.17.10.A10.1.454.CMB.2.raw
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (380)..(380): a, c, t, g, unknown or other
  misc_feature (380)..(380): n is a, c, g, or t
  modified_base (480)..(480): a, c, t, g, unknown or other
  misc_feature (480)..(480): n is a, c, g, or t
tcagcgtagactagcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagtacaggtgcccacgcccaggttcagttggtgcagactggggctgaggtgcagaagcctgggcatcagtgactgtctcngcaaggccagtggatatatcttcaanaaaatatgtatgaattgggtgcgacgacggcccccgganaagggcttggaggtggggtggggtggtcgagcggtcgtttggacggtaaggcacgagtatcgacaccgaagatgaagggnagagtcacgattaccacggaccaccccaacgaacacagtactacatcgacaactgacgagacctgagagactagacgacgacggcccgttatagtttacngttgacgtagtaaacttgtttactgtactagtacgtactaactttgattaacggctactactaggacttggtacttcgg

SEQ ID NO: 340318 - DNA, 662 bp, Homo sapiens
  misc_feature: GZ8MTXP02HXW0A.17.10.A10.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctctgcagccagtggatatatcttcaanaaaatntgtatgaagttgggngcgacgacggacccccggagaagggtcttggagggtggggtggggtggtcgaggtcggtcgtttaggaacgggtaaggcagtacgtatcgacccgaacgaagagtagggaaggcgaagcgtcgaaacgtacttaaccccgaacgggaacccacccccaaacggaaccaacgtacgtacctaacagtacggaccaacgtacggaacgacggtacctagggaacgaacggtcctacggaaccgaccggtaccggggtccccttattacgtacgtgttaggaccgtaaggttaacttttgttttcgaggtttactaacttacggttaaacttagttttagacgtttaggctttacgtaagtcgggtactacggttaccgtttcggaaccggggg

SEQ ID NO: 340319 - DNA, 633 bp, Homo sapiens
  misc_feature: GZ8MTXP02F9AT1.17.10.A10.1.454.CMB.2.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaagcagtgatatatctacacaaatntggtatgaattgggngcgacgacggccccgacgaggcgtgagggtggggtggggtggtcgaggtcggtcggtttcggacggtaagggctacgagtagtggacccgaaccggaagagtaggaagggacgagaggtacacgtaacgttacccgaaacgggacccaaacccccgaacgaacacacgtaactacgaactcgaacacgtacggaacgacgacctagaagacgtacgtacgacgaccgacgggtaccgtcttaacttacgtgtacggtacgtaagtacgtttcggtttactgtacgtacttacgttaacttacgtttagagttaacggtcgttattacgtaggtctacgggttactttacggggtacccgggg

SEQ ID NO: 340320 - DNA, 636 bp, Homo sapiens
  misc_feature: GZ8MTXP02ICFFG.17.10.A10.1.454.CMB.2.raw
  modified_base (286)..(286): a, c, t, g, unknown or other
  misc_feature (286)..(286): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggcagtgatatatcttcacaaaatatgtatgaattgggtgcgacacggcccccgganaaggctgaggtggggtggggtggtcgaggcggcgtttggacggtaggcaacgagtagtgcccaccggaagagtaggaagggcaaggtgtacacgtaacttaacccgaccgggaccaaacccccgaaacgaaaccacacgtacctaacatagacaacgtcgaacgagcccgtagagacgccgtaggaaccgacgaccgggtacccgtacttacgttacgtggttagaccgtaaggttaaacgtttcggttttacttacggttacctacttacctaaactttaccgtaaattttacggaagttaacggtacttacgttacgtacggtacgtttacgggtacgttttccgggg

SEQ ID NO: 340321 - DNA, 652 bp, Homo sapiens
  misc_feature: GZ8MTXP02IUD8F.17.10.A10.1.454.CMB.2.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaactaaaatntaggtatgtaattgggtgcgacgacggcccccggagaagggcttggagggttggggtggggtgggtcgaggcggtcgtttgggacgggttaaggcgaacgtagtagtcggacccaaccggaagagtaggaagggtccaaggcgtacaacgtaacttacccgaccggaccacccccgaagaacgacagtactacatacgacaacgtgaacgagacctaggagacgtcaggacgaccgacggaccgttacttacgttacgtggtacgacgtaagtaacgtttcgtttttacgtaggttactaacgtttaccggtaactttaacgtttagaacgttacggtaacttacgttagttacgggtactttcgggtaaccgtttcggggtaacccggggg

SEQ ID NO: 340322 - DNA, 640 bp, Homo sapiens
  misc_feature: GZ8MTXP02H0054.17.10.A10.1.454.CMB.2.raw
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (465)..(465): a, c, t, g, unknown or other
  misc_feature (465)..(465): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcgagtgacttgtctcctgacaaggccagtggatatatctacaanaaatgtgtanagtaagtgggtgacgacgacggcccccgagaggtctggagggtggggtggtgggtcgagggtcggtcgtttagggaacgggttaagcacgtagtagtgacccgaacggtaagagtaggaaggcaagcgtacgaacgtacgtaaacccgaccggaaccccaccccaaacgaaaccacgacgtacacgatcgactaacgngaacgcgaccgtagacgctacggaccgacgaccggccgttagtaacgttcgagacggtacgtaaggttatttcgtttacgtgtaccttagtaccgttaaagttagttttacgagttacgtacctttgtaacggtggtaacgttcggtaccggtttcgggaccgggtaacccgggg

SEQ ID NO: 340323 - DNA, 656 bp, Homo sapiens
  misc_feature: GZ8MTXP02HY3SC.17.10.A10.1.454.CMB.2.raw
  modified_base (256)..(256): a, c, t, g, unknown or other
  misc_feature (256)..(256): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (564)..(564): a, c, t, g, unknown or other
  misc_feature (564)..(564): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagcctggggcatcagtgactgtctcctgacaaggccagtggatatatcttacaanaaaatataggtataggtaagttgggtgacgacgacgggaccccccggaagaaacgggtcgttaggaagggtggggtggggtgggtacgaggtcggtcgtttaggacgggtaagcaagagtangaccgacgaagagtaggaaggcaggntacgaacgtaacttaaccgacgacccgaacccccaagaaaccacgagtacacacncgacaacgngaacgacgtccgagagacgcaggaacgacgtaccgggcccgttataacgtttaccgagtaggaccgtaaggtaaatttggttttactccggtttanaactttacggttaaccttaaaagtttcgtaacgttaggtaacccttacgtaaggtacggtacgttacggtaacgttttccgggacccggggg

SEQ ID NO: 340324 - DNA, 744 bp, Homo sapiens
  misc_feature: GZ8MTXP02II8B9.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatcccttttcctggtggcagcaggcacaggtgcccacgcccaggttcagttggtgcagacgtggggctggaggtgcagaagccgtggggcatcagtgactgtctcctgcagcagtggatatatcttacaactaaaatagttaggtataggtaaagtttgggtgaccggaaccgaccgggaccccccgggaagaaacggggtcgtttggaagggttggggtggggtgggtacgaggtcggtcgtttagggaacgggttaaggacgtaacgagtagtcgacccgaaccggaaagagtaggaaagggcgaaggacggtacgaaacggtaacttaacccccgaaccgggacccaaaccccccgaaacgaaacacgaaacgtaccaacgattacgactaaaccgtgaaccgtacggaccctaggaacggacgtcgtaacggaaaccggtacccgaaccggggttaccctaacgttaacgtttaacgtggttacggaccgtaaggttaaacgtttcgttttttacgagtttacctacgtttaccgtaaactttagtttaacgtaacgttaggccgtttaacgttagtaccgggttaaacgttcgggtaacgttttacgggaccggggg

SEQ ID NO: 340325 - DNA, 572 bp, Homo sapiens
  misc_feature: GZ8MTXP02IKLJZ.17.10.A10.1.454.CMB.2.raw
  modified_base (454)..(454): a, c, t, g, unknown or other
  misc_feature (454)..(454): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaagccagtgatatatcttacacaaaatatgtatgaattgggtagcgacgacggccccggacgaaggcttggaggtgggtggggtgggtcgaggtcggtcgtttaggacggtaaggcgtaacgagtagtgacccgaaccgaagtagtaggaagggcagcgacacgtaacttaccgacggaccaacccccacgaacacagtctacagtgacactgacgagaccgtgacgngcgtacggacacgcggaccgttcgtattactggtcgacgaagtagttcgtttactgtctataccgtatagtttcgaagtggtctagtagtacggacgtacggtactacggtaccgggg

SEQ ID NO: 340326 - DNA, 742 bp, Homo sapiens
  misc_feature: GZ8MTXP02GQJC9.17.10.A10.1.454.CMB.2.raw
  modified_base (625)..(625): a, c, t, g, unknown or other
  misc_feature (625)..(625): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtgggcatcagtgactgtctctgacgagccagtgatatatctacaataaatgtaggtatagtaagttgggacgcgacgaccggacccccggagaacgggtcgttaggaggggttcggggtaggggtcggtacgtacgggtcgggttacgttttacggggaacgggttaaggaccctaaggtaggtacgtacggaaccccggtaaaccggaaaggtagtaacggggaacgggtacgaacggtacgggttacccgaaaccggttaaaccggttaacccccggaacccggaacccccgaaacccccgtaaacggaaaccctaacgtacccggttacaaacgtacgacggaacctaacggtacggaaccgtacgaccgtaggacgacgtaccgaggacccgacgaccgggtctacgtagttcgngtacggagtagttagttttcgttactacgttactacgttacgtttaacttagttacgtagtttaccgtgttacggttagtccgggtagtacggtttaccggtcgggtaacccggggg

SEQ ID NO: 340327 - DNA, 692 bp, Homo sapiens
  misc_feature: GZ8MTXP02JHNJ1.17.10.A10.1.454.CMB.2.raw
  modified_base (534)..(534): a, c, t, g, unknown or other
  misc_feature (534)..(534): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgacttgtctcctgcaaggccaggtggatatatcttacaacaaaatagtggtatgtaagttgggtgacgacgacgggcccccggaagaacgggcgtttaggagggttggggtgggggtaggggtcgacggtcgggtcgtttagggaacgggttaagggccgtaaacgaggtaatcggaccgtaaccggaaaggtacgaggaacggggaccgaaggacggtccgaaacgtaacgttaacccgaccggggaaccaacccccgaacgaaacccacacgtacctacatcggaacaacgtacgacgacgacccgagaccgganaccgttacggaaccgaaccgggacgggtacccggtacttaacgtttacgtcggttacgacggtaagtaacgtttcgttttcgtacgtctaacgttaccgtaacttacgtttacggatacggtctataggtacgtacgtcggtacgttcggtaccgggg

SEQ ID NO: 340328 - DNA, 675 bp, Homo sapiens
  misc_feature: GZ8MTXP02JJ0A5.17.10.A10.1.454.CMB.2.raw
  modified_base (593)..(593): a, c, t, g, unknown or other
  misc_feature (593)..(593): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttacaactaaaatatggtatgtaagttgggtgcgacgaccggacccccggagaagggtcttggagggtggggtggggtgggtcgaggtcgggtcgtttacgggaacgggtaaggcaacgtagtagtgaccccgaacgaagagtagggaaggcgaaggtagtaccgaacgtaaccgttacccgaaccgggaaccccaacccccgaaacggaaacccaacgtaacgtacctaacactcgaacaacgtacggaacgacgcccgtaggaacgtacgacgtacggaaccgaccgaccgggtaccgttacttacgttacgtggtacggacgtaagttagtttacgttttacgngttactaacgttacgttaaacgttagtttagacgttagtcgtacgttacgtacggtacgttacggtacgtcgggtaccgggg

SEQ ID NO: 340329 - DNA, 610 bp, Homo sapiens
  misc_feature: GZ8MTXP02IKHCB.17.10.A10.1.454.CMB.2.raw
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtgatatatcttacaacaaaatatggtatgaatgggtgcgacgacggcccccgganaagggcttggaggtggggtggggtgggtcgaggtcgggtctttgggacggtaagcacgagtatgcaaccgaagagtaggaaggnagagtcaacgtattacccgaccgaccaaccccacgaaaccacagtacacatgacaacgtgaacgagaccgtgagagcgtacggacgacgacgggtaccgtacgttattaccgtgtcggacgtaagtaactttgttttacctggttacctagttaccggtaaacttacgttttaacggtagttacggtaacttacgtaacgttacggtacgtttacggtaacgtttcggtaccggggg

SEQ ID NO: 340330 - DNA, 645 bp, Homo sapiens
  misc_feature: GZ8MTXP02I2U4U.17.10.A10.1.454.CMB.2.raw
  modified_base (404)..(404): a, c, t, g, unknown or other
  misc_feature (404)..(404): n is a, c, g, or t
  modified_base (456)..(456): a, c, t, g, unknown or other
  misc_feature (456)..(456): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagtttggtgcagacgtggggctggaggtgcagaagccgtggggcatcagtgactgtctctgcaaggcagtgatatattctacaacaaaatgtggtatggtaagttgggtgcgacgacgggcccccgaagaacgggtcttggacgggtggggtggggtggtcgaggtcggtcgtttgggaacgggttaagccgtaacgagtacgtgacccgtaaccggaaagacgtaggaaaggggnaaggagtccgaacggtaacttaacccgacggaacccaacccccgagaaaccncaacgtctacatcgactaacgcgaacgacgccgtagagacgtactacggaaccgaccgacgggtcctacgtacttacgcggtacgacgaacgttagtttcgtttcgtaggttctacgtaacttagttaaacgtttcgaagtacggtaattactaaggttcggaacgttcggtaccgttccggtaggggg

SEQ ID NO: 340331 - DNA, 582 bp, Homo sapiens
  misc_feature: GZ8MTXP02HSJ0E.17.10.A10.1.454.CMB.2.raw
  modified_base (367)..(367): a, c, t, g, unknown or other
  misc_feature (367)..(367): n is a, c, g, or t
  modified_base (478)..(478): a, c, t, g, unknown or other
  misc_feature (478)..(478): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacacggcccccggacaagggcttggaggtggggtggggtggtcaggcggtctttggacggtaagcacgagtatgccacgaagatgaggcagngtcgacgattacccgacggacccaaccccacgaacgacacgtctaacatgacaactgaacgacgtccaggagacgctaggaaccgacgaacggggcctacgttagttacgnggttcgcgtaaggtaattggttttctggttccagttccgtaacttaatttgaacgttcggtctacgtagttaccgggatttcgggtaaccctttggtccggggg

SEQ ID NO: 340332 - DNA, 637 bp, Homo sapiens
  misc_feature: GZ8MTXP02GJRBP.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaattgggtgcgacgacggcccccgagaagggctggaggtgggtggggtgggtcgaggtcggtcgtttaggacggttaaggcaacgagtatgacctaccgaagacgtaggaaggcgaaggacgtacacggtaagtaacccgaaccggaacccaaccccaaccggaacaccgaacgtacctaacgatacgacacgtacggaacgacgaccgtagaacgagtaccgaggaacgaccgtaccgggaccgttacgtattacgtagtcggtataagtagttcgttttcgtacgttatacttacgtaactaacgtttagaacgttaggtaacttacgttaaggtcgtacgttacggtaccgttttaacggccggggg

SEQ ID NO: 340333 - DNA, 709 bp, Homo sapiens
  misc_feature: GZ8MTXP02HWW6A.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggcagtgatatatctacaacaaatagtggtatagtaagttgggtagacgacgacggcccccggaagaagggtcgttaggaggggttggggtggggtacggggtcgaggtcgggtcgttttagggacgggttaaggctaacgagtacgtcgaccgaaccgaagagtagggaagggacgaagtggtactaacgtaacgttaaccccgaaccgggtacccccaaacccccgaaacgaaacctaaccgaacgtacctaacgacgtacgacaacgtacgaacgtacgcctaggaacgcgtacgacggaaccgacgaccggggtaccttagtacgttacgtacggtcgaacgggtataacgtttcgttttcgtacggttacctaacgttacgttaaaccgttaatttaccggtaagttacggtaacgtttacttaaacggtcggtaacggtttacgggttaccgttttaccggggaaccggggg

SEQ ID NO: 340334 - DNA, 515 bp, Homo sapiens
  misc_feature: GZ8MTXP02HXLI4.17.10.A10.1.454.CMB.2.raw
  modified_base (365)..(365): a, c, t, g, unknown or other
  misc_feature (365)..(365): n is a, c, g, or t
  modified_base (425)..(425): a, c, t, g, unknown or other
  misc_feature (425)..(425): n is a, c, g, or t
  modified_base (468)..(468): a, c, t, g, unknown or other
  misc_feature (468)..(468): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtgggtggggtgggtcgaggcggcgtttgacggtaggcacagtatgccaccgagatgaagggcagngtcacgattaccacggacacccccacgaacacagtctacactgcaactgacgagcctganagctgacgacacggccgtctattactgtgcgagaatgttttcngttcatcgtactatttgataggctctatggactggacttcgtcgggg

SEQ ID NO: 340335 - DNA, 734 bp, Homo sapiens
  misc_feature: GZ8MTXP02F46D6.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctccctctcctcctcacccttctcattcactgcacagggtcctgggcccagtctgtgttgacacagccgccctcagtgtctgccggcccccggacaggaggtcaccgatctcttgctctcggaaacccccctaatgttcggattcgaattatgtagtcctggtaccagacaacctcccgggatccgaacgcccccaaactcctacatatacgtagaaagtataactaaacgccgtaaccctacgtacggggttaccccctacggacccggtaacttaccgtcccgttacggggtacccttcccggtaaaacggttcccgtttcgggggaccccttaaacccggttccgtttaccgggtaaacccccccgtacccggtacggaccctaacgtaccccgacccggtccgtacccgtaccgacggtaccggtacggggaaccgaccggtaccgttacgttacgtttaccgagaccgtacgaaacgtacggtacggtacttaccgacgtccgtacggtaccgtttcgggtacggggttcgtaccgggtacgtacggtaccggaaccgtacggtccgtacggtaacccggttcgtacggtaccgaccgtacccggtacggtccgtcccg

SEQ ID NO: 340336 - DNA, 613 bp, Homo sapiens
  misc_feature: GZ8MTXP02IR7R3.17.10.A10.1.454.CMB.2.raw
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (384)..(384): a, c, t, g, unknown or other
  misc_feature (384)..(384): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtgatatatcttacaacaaaatntggtatagagttgggncgacgacggccccggagaggcttggaggtggggtggggtggtcgaggtcggtcgtttagggacgggtaaggcacgtagtagtcgacccaacgaagagtaggaaggcagngtcaacgtactacccgacggacccaaccccgaagaaccacagtactacactagactaacgngaaccgagccgngaggaacgtgtacggacgacccgtcgggtacccttacgttacgttacgtgtacgtaggtaattagttttcgtttcgactagtacgttaccgtaatacggttttaagagttacgtcgttacgtacgtacggtacgttacggtacgttcgggacgggg

SEQ ID NO: 340337 - DNA, 744 bp, Homo sapiens
  misc_feature: GZ8MTXP02H1IP9.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgacaaggcagtgatatatcttacaacaaaatatggtatgtaagttgggtgcgacgacggacccccggaagaagggcttggagggttggggtgggggtgggtcgaggtcgggtctttagggacgggttaaggcaagtagtatgacccgaaccgaagagtaggaagggcaggcggtacaacggtacgttaacccgaaccgggacccaaaccccccgaaacgaaaccgacgtaaaccggtactaacgacttacggaacctaaaccgtcggaaaccgacgacccgtaggaacggacgaccgtacgggaacccgaaccgtaccggggtaccccgttacgttaacgtttacccggttaggtacgtaccggttaaaggttaaacgttttcggttttaccgtaggtttacctacgttacccggttaaactttaacgttttggaaaacgttacgggtaaccttacggtttaaaacggttcgggtaaaacccgttggggttacccgttttaacggggtcccgggggg

SEQ ID NO: 340338 - DNA, 625 bp, Homo sapiens
  misc_feature: GZ8MTXP02H7JJD.17.10.A10.1.454.CMB.2.raw
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (515)..(515): a, c, t, g, unknown or other
  misc_feature (515)..(515): n is a, c, g, or t
  modified_base (531)..(531): a, c, t, g, unknown or other
  misc_feature (531)..(531): n is a, c, g, or t
  modified_base (539)..(539): a, c, t, g, unknown or other
  misc_feature (539)..(539): n is a, c, g, or t
  modified_base (554)..(554): a, c, t, g, unknown or other
  misc_feature (554)..(554): n is a, c, g, or t
tcagcgtagactagcacgaccggtgctcgatttagcgtcgatctcagggacccaaaaaccacacccctccttgggagaatcccctagatcacagctcctcaccatggactggaccctggagcattcccttttcctggtggcagcaggcacaggtgcccacgcccaggttcagttggtgcagacgtggggctggaggtgcagaagcctggggcatcagtgactgtctcctgcaaggccagtggatatatcttacaacaaaatataggtataggtaaagttggggtaggacgaaccgaccggaccccccggaagaacggggtcttggagggttggggtggggtggggtcgaggcggtcgttttggaacgggtaaggcaacgaagtangacccgaacgaaganaggaagggcaaggattacgaacgtacttaaccgaaccggaaccccaaacccccaaacgaaaccctaacaacgtactaaccaagcgactaaacncgaacgngccctagaagctcgngaccgacgaccgcgtntaattcgngtgacgtagtagttntttcgtgtactactactacttacgttagtagtagtcgtactacgtacgtacgtacgtacgttacggtacgg

SEQ ID NO: 340339 - DNA, 707 bp, Homo sapiens
  misc_feature: GZ8MTXP02I970T.17.10.A10.1.454.CMB.2.raw
  modified_base (254)..(254): a, c, t, g, unknown or other
  misc_feature (254)..(254): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagagccgtgggcatcagtgactgtctctgcaggcagtgatatatctacaacaaatntggtatgtaagttgggtgcgacgaccggcccccggagaggtcttggagggttggggtggggtggtcgaggtcggtcgtttagggacgggttaaggctaacgtaggtacgtcgacccgtaaccggaagtagtagggaaacgggcaagggtacgtaccgaacggtaacgttaaccccgaccgggaacccccaaacccccgaacggaaaccctaaccgtaacgttaccaaacgtagtaccgacaaccgtacggaaccgacggccgtaggacgacgaccgtacggaccgtacccggaccgggtacccgttacgttaacgttacggtggtacgacggtaacgttaacgtttgttttaccgtggttactacgttaacgttaaacgttacgtttaggacgtttacgtaacgttacgttacggtacggttacgttacggtacggtttcggtaacccggggg

SEQ ID NO: 340340 - DNA, 621 bp, Homo sapiens
  misc_feature: GZ8MTXP02GAQEK.17.10.A10.1.454.CMB.2.raw
  modified_base (248)..(248): a, c, t, g, unknown or other
  misc_feature (248)..(248): n is a, c, g, or t
  modified_base (385)..(385): a, c, t, g, unknown or other
  misc_feature (385)..(385): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttnaacaaaatatggtatgaagttgggtgcgacgacggcccccggagaagggcttggaggtggggtggggtgggtcgaggcggtcgtttggacgggtaaggcacgaggtatcggaccaaccgaagataggaagggcaggngtcaacgtacttaacccgacggaacccaacccccgaagaaaccacgtacgtactaacatgacaacgtacgaacgcgacctagacgagcgtagaccgaccgaccgggtaccgtactacgttacgtggtacgacgtaagtacgtttcggttttactggttactacgttacgttaaactaacgtttagtacgttaggtccttagtagtcggtacgttcggtaacgttcggtaccggggg

SEQ ID NO: 340341 - DNA, 744 bp, Homo sapiens
  misc_feature: GZ8MTXP02HQ0F1.17.10.A10.1.454.CMB.2.raw
  modified_base (257)..(257): a, c, t, g, unknown or other
  misc_feature (257)..(257): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatntggtatgtaagttgggtgacgacgacggcccccggaagaagggcgtttggaggtggggtggggtgggtcgaggcggtcgtttggacgggtaaggcaacgagtagtcgaccccgaaccggaagagtagggaaggggccgaaggacggtacgacgtaacttacccgacgacccaaaccccccgacgaaaccacagtaccgtaacagtcgtaccaaaccgttacgaaccggacgtacccgttagggaacgaacggtccgttaacggtaaccggaaccgtaacccgggggtacccctttaacgtaaacgttttaccgtagggttacgtaaccgggagttaaaagttttcggttttttaccgtaaggggttttcctaaacgtttacccgggtttaaacttaacggttttagttaacgttaaacggggttcctttaacgttaggttacgggttaacgtttcggggttaccctttacggggttaacccgggggg

SEQ ID NO: 340342 - DNA, 637 bp, Homo sapiens
  misc_feature: GZ8MTXP02IKE6V.17.10.A10.1.454.CMB.2.raw
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcggccggccccccggagaggacggtcaccatctcttgctctaccggaaacccccctatgtggattcaattatgtgtcctggtacagaccactcccggatccacgcccccaaactccacatatatagaanataanacgccgaccctacgtacgggtcccctagaccgtatctctcgctccgaatcgtcgctaccgtctccgcctacccgtggaccacgtaccacccgcgtccaccgacgacggtacggggaccgacggtaccggtagttactttcgtcgaccgactaaaccgagttaccgggtactttacccgacgtccgtacgtaccgtttcgggttcggggttcgggttccggacggtacggtacggggtacccgaacgtccggttaccgtaacccggtaccgttacggccgtaccggtaccgaaccggtcccggtacccccg

SEQ ID NO: 340343 - DNA, 675 bp, Homo sapiens
  misc_feature: GZ8MTXP02H1XMU.17.10.A10.1.454.CMB.2.raw
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacaacaaaatataggtatagtaagttgggtgccggaacgaccgggaccccccggaagaaggggtctttagggagggttcgggggtggggtgggtcgagggtcggtgtttagggacggtaaggcaaacgtagtatggacccaccggaaagagtaggaacggggcaagtggtaccacgtaactacccgacgggaaccccacccccgaaacgaacacaacgtcctaacatcgactaacgtacgaaccgagcctagacgancgtaggacaacggngcccgtatacgtacgtcgacgacgagttaatttcgtttttccgagtttctaaacgtttaccgttaaacgttaaacgtttcggtaaacgttagggtccctttaagttaacggttcggttaaccgtacgggtttaacccggtttcgggtaacccgggggg

SEQ ID NO: 340344 - DNA, 659 bp, Homo sapiens
  misc_feature: GZ8MTXP02IC7W7.17.10.A10.1.454.CMB.2.raw
  modified_base (306)..(306): a, c, t, g, unknown or other
  misc_feature (306)..(306): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatataggtatgtaattgggtgcgaccacggcccccggacgaacgggcttgnggtggggtggggtgggtcgaggcggcgtttggacggtaggcgacagtatgccaccgaagagtaggaaggcaggcgtacaacggtacttacccgacccggtaccaaccccccgaacgaaaccacacggtctaacgatcgaccaacgtagacgacgacccgtggaagacgtactcggaaccgaccgaccggggacccgttacgttaacgttacgtcgtacgggcgtaaaggtaagtttacggttttttacgtacgttactaacggttaccgttaaacgttaacgttttaggaagtttacggaactttcgttaacgttcgggtaacgtcggttaaccggtttccggtaccgggggg

SEQ ID NO: 340345 - DNA, 611 bp, Homo sapiens
  misc_feature: GZ8MTXP02JNPQU.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggcagtgatatatcttcacaaaatatggtatagaattgggtgcgacgacggcccccggacgaagggcgtttgaggtggggtggggtgggtcgaggcggtcgtttggacggtaaggcacgagtagtgaccaccgaagtagtaggaaggggacgagacgtacgaacgtacgttaacccaacgggaccccaaacccccgaaccggaaaccaccgaacgtacctaacactacgactaacgtaggaacgacgaccgtagaacgacgctagaccgacgaccggaccgtacgtacgttactgtcgacgtagtaattgtttactgtctaatcgtaactacgtttagattaaggtcttacgtagtacggactacggtacttcggtaccgggg

SEQ ID NO: 340346 - DNA, 715 bp, Homo sapiens
  misc_feature: GZ8MTXP02IAU8B.17.10.A10.1.454.CMB.2.raw
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagcccgccctcagtgtctcgccggcccccggacgaggaggtcaccatctcttcgctctaccggaaccccccagtgttgatcaatatgtgtcctggtaccagcaaccgtccggactccaccgacccccaactcctacaatactatagaanaataaatagaccgtacctcgtacggttcccacgaccgnttactcgtcggctccaagtcgtcgacctaccgttcgaccgtccccgtaaccccgtggggaccctaaccgttccccgacccgggtcccgtcccgttacccggtaacggacccggggttaacgggggacccggaaaccggggtccccggttaaaggtttccgttttaccggacggtacccggtaaccgtaacgtaacggtacgggtaacctttccccggaacgttccccgtacgttaccggtttcccgggttcgggggttccgtttaaccgggcgtacgggggtcgaaccgtacggtacctccgggtaacccgtacgttacggccaaccggacccggtaacgtccgtccccccgg

SEQ ID NO: 340347 - DNA, 703 bp, Homo sapiens
  misc_feature: GZ8MTXP02IYSH1.17.10.A10.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctcctgcaaggccagtgatatatctcaanaaatntggtatgaattgggncgacgacggcccccggagaacgggcttggaggttggggtggggtggtcgaggtcggtcgtttaggacggtagctaacgagtagtcggacccaacggtaagagtaggaaggcaaggcgtacacgtactaacccgaccggaacccaccccaagaaccactacgtactaacagtcgaactaacgtagaccgtacgaccgtagaacgtacggtacctaacggaacccgacccggtaccgggtacccccgttacttaacggtttaacctgggttaacggacgtaaagttaacgttttcggtttttaacgtacgtttaccgtaaacgttttaaccggtaaaactttacgggtttaacgtaacggtttacggtaacccttttacggtaaggttacggggtaccgttacgggtttaaccggtttcggggtaaacccggggg

SEQ ID NO: 340348 - DNA, 592 bp, Homo sapiens
  misc_feature: GZ8MTXP02F8CNR.17.10.A10.1.454.CMB.2.raw
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagcgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggccccggacaagggcttgagtgggtggggtgggtcagcggcttgacggtaaggcacagtatgcaccgaagatgaaggcagagtcacgataccacggaccaccccacgaacacagtctacatcgacaactgacgagcctagagacgctagacgacgacggcctntatcngtgcgatattgtttcngtctatacgtaactatttgataggtcttatagtgtacgtacggtacgttcggtggggccgtaagggggtacccaacggtgaacgttcggtctcgactcgaccggtaccctaccgaaaccgtaaccgggccctacgttcccgttcccgttcccccgtcggtaaccccgtaaccccttccgacccgaacgtaccgcccgtaccgtttacccgggg

SEQ ID NO: 340349 - DNA, 743 bp, Homo sapiens
  misc_feature: GZ8MTXP02IYZMU.17.10.A10.1.454.CMB.2.raw
  modified_base (264)..(264): a, c, t, g, unknown or other
  misc_feature (264)..(264): n is a, c, g, or t
  modified_base (484)..(484): a, c, t, g, unknown or other
  misc_feature (484)..(484): n is a, c, g, or t
  modified_base (603)..(603): a, c, t, g, unknown or other
  misc_feature (603)..(603): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagagccgtgggcatcagtgactgtctccgtgacaaggccagtggattatattcttacaactaaaatntaggtatgtaagtttgggcgacgacgaccgggcccccggaagaagggtcgtttggacgggttgggggtggggggttcggtacgagggtccggttacgttttagggaacggggtaacggcgtaacgtaggtacgtcgaacccgaaccggaagtacgtagggaaggcaaggtacgtcgaaacgtacgtaacccgaccggaacccacccccgaaacgaaaccncgtacgtacctaagacgtacgaactaacggtagaaccggtacgtaccgtaggaacggtacgaccggtaacggaccggaacccgtaaccggggtccctttaacgttaaggtttaaccggngggtaacggtaaccgttaagtttacgttttcgtttacgtacgttaccgttaaacgttacgttaacttaggttacgtaacgtacggttaacttacggttaacggtcggttaacgttcgggtaccggtttacggggacgggg

SEQ ID NO: 340350 - DNA, 676 bp, Homo sapiens
  misc_feature: GZ8MTXP02G4ENS.17.10.A10.1.454.CMB.2.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctcctgcaaggccagtgatatatctnaacaaatntggtatgagttgggngcgacgacggccccganaggcttggaggtgggtggggtggtcnggcggtntttagggacggtaagcagngtatgacccacgagagtaggaggcaggngtacagtactaccgacggacccaccccgagaacacagtacacatacgacaactcgacgacgcctaggagacgacgtaggaaccgaccgtaccgggtacccgttacgttaacgttaccgttggtacgggtaaccgtaaagggttaaatttttccgggttttaaattccgggtttacctaacggtttaacggttaaacctttaaacggttttcgggaaacgtttacggggtaacctttaccggtttaaaaggttacggggtaacccgtttacggggtttaacccggtttccgggggtttaacccgggggg

SEQ ID NO: 340351 - DNA, 637 bp, Homo sapiens
  misc_feature: GZ8MTXP02JGU0U.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaggcagtgatatatcttacaacaaatatggtatggaagttgggtgcgacgacggcccccggacgaaggcgttggagggtggggtggggtgggtcgaggtcggtcgtttggacgggtaaggcacgagtatcgaccgacgaagagtaggaagggacaggacgtcgaacgtacgtaccgaccggaacccaccccaacgaaacacacgtactacatcgacacgtacgacgacgacctggaacgcgacgtacggacccggaccgaccgggtacccgttacgttaacgttacgtcggtaggacgtaagttaagtttcgttttccgtagttaccgtaacgtaccgttaagttacgtttacgaagttaggtaacgtcttacgtcggtagttcggttaaccgtcgggttaacggggg

SEQ ID NO: 340352 - DNA, 732 bp, Homo sapiens
  misc_feature: GZ8MTXP02G3GCY.17.10.A10.1.454.CMB.2.raw
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctcctgcaggccagtggatatatcttacaacaaatntaggtatgtaagttgggtgcgacgacgggacccccggagaagggtcttggagggttcggggtggggtgggtcgaggtcggtacgtttgggaacgggtaaggcgtaagtacgtagtacggacccgaaccggaagtaggtaacgggaaggggtaccgaaaggggtacgggttacccgaaaccgggtttaaccgttaaaacccccggacccggggaaaacccccaaaccccccccgtaaacggaaaaccacgtaaaccgtaccaactacgtacccgacgtaaccgtaggaaccgacgaccgtaggaacgacggtacgcggaaccggacgaccggtaccgtacttagttaccgtgtacggacgtaggttactttacgttttaccgtgtaccttagttaccttaaagtttaacgttttacgaagttacggtaacttgtaggttacgtacggttcggtaaccgtttcgggaacccggggg

SEQ ID NO: 340353 - DNA, 645 bp, Homo sapiens
  misc_feature: GZ8MTXP02JZSOQ.17.10.A10.1.454.CMB.2.raw
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcagaagccgtggggcatcagtgactgtctcctgcaaggccaggtgatatatcttacaactaaaatntggtatgaagttgggtancgacgacggcccccgganaagggtcttgaggtggggtggggtggtcaggtcggtcgtttaggacggttaagccaacgtagtagtacggacctaaccggaagtagtacgggaaggggaccaagggtccgtacgaaacggttacgtaacccgaccgggtaacccccaaccccccgaacgaaaccctacgaacgttactacgagtcggaacaacggtagaaccggacgcctagaacggacgtacggacgaccggaccaccggggtaccttactagtttacgcggttagcggtaagtacttgtttccagtctagtacgtattagtcgtattaggcctagtacgcggtactcggtacgttggaccgggg

SEQ ID NO: 340354 - DNA, 629 bp, Homo sapiens
  misc_feature: GZ8MTXP02FOET3.17.10.A10.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
tcagcgtagactagcacgaccggtgctcgatttagcgtcgatctcagtggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaagccagtgatatatctacaanaaatntagtatagaagttgggnacgacgaccgggcccccgaagaacgggtctggaggtggggtaggggtggtcgaggtcggtagttggaacgggtaagcgacgtagtagcgacgaccgaaagtagtaggaaaggctaggagtacgacgtacgtaacccgaaccggacccaacccccgaagaaaccacacgtacacgtaanacgacgaagacgacgacncgtaggacgacgtacgacgaccgacgaccggtaccttacgtacgttacgtggacgtacgtaagttacgtttcgtttacgtcgtacgttaacgttacgttaacgttaagttagtacgtaacgttacgtacgttacgtacggttacgttacggttacggtcgg

SEQ ID NO: 340355 - DNA, 683 bp, Homo sapiens
  misc_feature: GZ8MTXP02GQ0DP.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatcccttttcctggtggcagcaggcacaggtgccccacgcccaggttcagttggtgcagacgtggggctggaggtgcagaagccgtggggcatcagtgactgtctcctgcaaggccagtggatatatcttacaacaaaatatggtatgaattgggtgtcgacgacggcccccggacgaagggtcttggaggtggggtggggtggggtcgaggcgggtcgtttacgggacgggtaagggcacgaggtagtgaccccgaaccggaagagtacgggaaggggcgaaggtagtacgaacgtaagttaacccgaaccggaccaaccccccgacgaaaccacgacggtccaacactagaccaacgtgaaacgtagacccgtggaacgagacgtacggaccgaccgaccggggtacccgttacgttaagttacgttcggtacggccggtaagtaaagtttcgttttacgttacgtacttcgttaaacgttacttaaagtttacgtaattaacgggctttacgtaagttacgggtacgttacgggtaccgtttccggggtaaccggggg

SEQ ID NO: 340356 - DNA, 646 bp, Homo sapiens
  misc_feature: GZ8MTXP02FPW61.17.10.A10.1.454.CMB.2.raw
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaactaaaatatggtatgaagttgggtgcgacgacggacccccgganaagggctttggaggtggggtggggtgggtcgaggtcggtgtttaggacgggtaaggcacgagtagtgacccgaccggaagagtaggaaggggacaaggcgtacaacgtacttaacccgacggaacccaacccccgacgaaaccacacgtacaacatcgaacaactcgaacgacgaccgagaacgacgcacggaacgaccgaccgggtccgtacgttacgttacgtcggttacgaccggtaagtaacgtttcggttttactacggtacttacgttaccgttaaacttaacgttttacgaagttaaggtccttagttagtacgggtaacgtcggttacgttcggtaaccggggg

SEQ ID NO: 340357 - DNA, 649 bp, Homo sapiens
  misc_feature: GZ8MTXP02JZW4E.17.10.A10.1.454.CMB.2.raw
  modified_base (275)..(275): a, c, t, g, unknown or other
  misc_feature (275)..(275): n is a, c, g, or t
  modified_base (480)..(480): a, c, t, g, unknown or other
  misc_feature (480)..(480): n is a, c, g, or t
  modified_base (586)..(586): a, c, t, g, unknown or other
  misc_feature (586)..(586): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagagccgtgggcatcagtgactgtcctccgtgcaaggccagtgatatattcttcaataaatgtgtatgtaagttgggnacgtacgacggaccccggagaagggtcttggtagggtcggggttggggtacggcgtaggtcggttcgtttacgggaacggttacggcaacgtagtagtcggaccccgacgaagtacgtaggaacgggtcaggtacgtaccgaacggtaaccttacccgaaccgggaacccctaacccccgaacgaaaccacgtaacttacccaanagtacccgacaacggttcgaacgtacgccctaggacggagtccgaggaccgaaccggtccggtacttactacgttacgtcggtacgagtacgttatgttttaccgntactacgttagtactacgtcgtacgtcgtaacgttgtacgtacgtgttcggtacgtcggacgg

SEQ ID NO: 340358 - DNA, 708 bp, Homo sapiens
  misc_feature: GZ8MTXP02I0R37.17.10.A10.1.454.CMB.2.raw
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcgaagccgagtggatatatctacaanaaatataggtatagtaagttgggngacgacgaccgggacccccggaagaacgggtcttaggagggttgggggtggggtgggtcgaggtcgggtcgttttagggaacgggtaaggactagagtagtcgacccgtaaccggaagagtagggaagggtacgacggtagtccgaaacggtaaccgttaaccgaaccccggaacccccaaacccccgaaacggaaacccacgtaaccgtaccgtaactacgtacgacaaccgtacgacggaaccgacccgtagaacggacgtacccgtacggaacccgaccgtacgggtaccctaacgtttacgttgtagtacggacgtaagttagtttcgttttcgtgtactacgtaacgttaacttagttacggtagtacggttaacttacgttacggttacggtaccgtaggtttaccggttacgggtacggggg

SEQ ID NO: 340359 - DNA, 660 bp, Homo sapiens
  misc_feature: GZ8MTXP02JV2LI.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtgatatatctacaacaaatataggtatagaagttgggtgcgacgacggcccccggagaaggtcgtgagggtggggtaggggtggtcgaggtcggtcgtttagggaacgggttaaggcaacgtaggtactggacccgaccggaagtagtaggaagggcagcgtacacgtaacgtaccgaccgaacccaccccgaacgacgactacgtactacatcgactaacgacgacgacgcctaggagacgctacgaccgacgacgggtcctacgtacttacgtggtacgagtaagttaacgtttcgttttacgtcgtttacgaacggtttaccgtaaacgtttaacgtttaggtaaccgttaggtaaccttacgtttaaccgggttaggtaccggttaccgggttaacggtttcccggggtaacccgggggg

SEQ ID NO: 340360 - DNA, 569 bp, Homo sapiens
  misc_feature: GZ8MTXP02HU1SK.17.10.A10.1.454.CMB.2.raw
  modified_base (290)..(290): a, c, t, g, unknown or other
  misc_feature (290)..(290): n is a, c, g, or t
  modified_base (382)..(382): a, c, t, g, unknown or other
  misc_feature (382)..(382): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggccccccgganaagggcttggaggtggggtggggtgggtcgaggcgggtcgtttggacgggtaaggcacgaggtatgccaccgaaagacgtggaagggcaggngtcacggattaccgaacggaccaacccccacgaaaccacagtctaacatgacaactggacgagcctaggagagctaggacgaccgaccgggcccgtntaacttactggtgacgtagtaaattggttttctgtctattccgtaactaagtttgaataggcctgtaagtggactggtactttcgcgggg

SEQ ID NO: 340361 - DNA, 660 bp, Homo sapiens
  misc_feature: GZ8MTXP02HPFP3.17.10.A10.1.454.CMB.2.raw
  modified_base (249)..(249): a, c, t, g, unknown or other
  misc_feature (249)..(249): n is a, c, g, or t
  modified_base (404)..(404): a, c, t, g, unknown or other
  misc_feature (404)..(404): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaaggcagtgatatatctanaactaaaatagtggtatagaagttgggtgacgacgacggccccggagaagggtcttaggaggttgggggtggggtggtacgaggtcggtgtttagggaacgggtaaggcaacgtagtatcggaccgaaccggaagagtaggaaacgggcgaaggngtacaaacgtaaacttacccgaacggacccaacccccgaaacgaaacacaaggtactacgatacgacaaacgtacgaacgacgtccaggagcgcgacggaaccgtaaccgaccgggaccgttacgttaactacgttaggacgtaccgtaagtaacgttttctttcgtaggttactaacgttaccggttaaactaacgtttacgaagttacggtaacttagtaacgtgggaacttacggtacgtttacggccggggg

SEQ ID NO: 340362 - DNA, 648 bp, Homo sapiens
  misc_feature: GZ8MTXP02GPD4U.17.10.A10.1.454.CMB.2.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (364)..(364): a, c, t, g, unknown or other
  misc_feature (364)..(364): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacaggtgcccacgcccaggttcagttggtgcagacgtggggctggaggtgcagaagccgtggggcatcagtgactgtctcctgacgagcagtgatatatctanaanaaatntggtatgaagtgggncgacgaccggccccggagaacggtcgtaggacggggtggggtggggtggtcgaggtcggtcgttaggacggtaagcagagtagcgccgacgangtagaggacaggcgacaacgtactaccgacgacccaaccccgaacgtaaccacgtacgtactacgacgtaccgaacgtaacgtacgaacgaacggccctagggaaacgtcggttaccgacggaaccgtacccgaccgggtaccttaacgtttaacgttcgtcggtaacggtaccgtaaggttaatttccgtttagacggttacttacgttaccgttaacttaattaccggagttaggtcctagttaccgtaggtccgtacggttaccgtttcggggaaccgggg

SEQ ID NO: 340363 - DNA, 604 bp, Homo sapiens
  misc_feature: GZ8MTXP02IH008.17.10.A10.1.454.CMB.2.raw
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
  modified_base (461)..(461): a, c, t, g, unknown or other
  misc_feature (461)..(461): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcagcagtggatatatctacaacaaatatggtatgaagtgggtgcgacgacggccccgganaagggcttggaggtggggtggggtgggtcnggtcggtctttggacggtaaggcacgagtatgccgaacgaagagtggaaggcaaggtcgtacacgtaaacgttacccgaccggaacccacccccgaaacgaacctacacgttacacatcgacaacgtacgaacgacgtacgngaacggtgtacgacggacgaccgacgggtcctacgttacttacgtgtacggacgtaagtacgtttcgtttactacgtgtaacttacgtaacttaagttagtatagctttagagttacggtacgtcgttacgttcggaccgggg

SEQ ID NO: 340364 - DNA, 747 bp, Homo sapiens
  misc_feature: GZ8MTXP02JYH22.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggcccagtgggtatatacttctacaaactaaaatagtagtagtaagtaaggttcgggtggacgacggacccggacccccggaacggacggtcgtaggtaggggtgggggtagggggtcgggtaggacggcgggttcggtttacgggtaaacgggtacggtacgaacgtaagtagtacgaaccccgaaccgaaagtagaaggggaacggacgagtcgaacgacgtaacctaaccgaacgaacccccaacccccgaaacccgttaaaccaacgttacgtaccttaacgagacgactaaaaccgtcggaacgaacccgttgaaggaaacggcgtttccagggacccaaaccgggacccggtccgttaattaacttcggttgtacggcggtaattaagttttcgttttcgttacggcttaaccgggtttacgtaaaccttaaggtttacgttaaagtcggtaacccttggtttaaagcccggttaagggttaccggttaccgttttaacggggcccgggggg

SEQ ID NO: 340365 - DNA, 741 bp, Homo sapiens
  misc_feature: GZ8MTXP02HO4KM.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaattgggtgcgacacggcccccggaagaagggtcttggacgggtggggtgggggtgggtacgaggcgggtcgtttagggacgggtaaggcacgtagtagtgacccgaaccgaaagacgtaggaaaggggccaaggacggtacaaacggtaacgtttaaccccgaaccgggaacccaaaccccccgaacggaaaccaaccgaacggtacctaaacgatcgaccaacgtacggaaaccgacgacccgtagaacgacgtaccgtaggaaccgaaccgaccggggtcccgttaaccgttaacgtttaccgtgggtacggaacggtaacggttaaacgttttcggtttttaccgttacggtttactaaacgtttaccggttaaacttaaagttttacggtaaacgtttacgggtaacccttagtttaacggttacgggtaaacgtttccgggtaaccggttttcgggtaacccgggggg

SEQ ID NO: 340366 - DNA, 674 bp, Homo sapiens
  misc_feature: GZ8MTXP02FI5B7.17.10.A10.1.454.CMB.2.raw
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttanaacaaaatntgtatgaagttgggtgcgacgacggcccccggagaagggtcgttgagggtggggtggggtggtcgaggtcggtcgtttaggacggtaaggcacgagtagtcgaccgacgagagtaggacgggcaggcgtacgacgtaacgtaccgaccggaccaacccccgacgaaacacacgtactaacatacgacaacgtacggaacgacgtaccgagaacggganaccgtacggaaccgacccggaccgggtacccgtactttaagtaccgttggtacggaccggtaagtaacgtttcgttttaccgtaggttactaacgtttaccggtaaacgtttaacgtttacggtaagttacgggtaacctttagttaacggtacgggtacgttacggggtaaccgtttcggggtaacccgggggg

SEQ ID NO: 340367 - DNA, 746 bp, Homo sapiens
  misc_feature: GZ8MTXP02I29HO.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttacaacaaaatataggtatagtaagttgggtgacgacgaccgggacccccggaagaacgggtcgttggagggttggggtggggtgggtcgaggtcgggtcgtttagggacggtaaggcgaacgtaggtatggacccgaaccggaagtagtaggaaggtaaccgaggtacgtacgaacggtaaccgtttaacccccgaacccggaaccccaaacccccccgaaacggaaacccaaccgtaaccgtacctaaccgtagtacgaacctaaccgtaggaaccgtagacccgtaggacggaacgtccgtacggaaccgaccgaccgggttacccgtacgttaacgttacgtcggttacggaccgtaagtttaaacgttttcggtttttaaccgttcggtttaactaacgtttaaccggttaaactttaacggtttagtacgtttaaggtcctttacgttaaggttccggtaacgtttcggttaaccgtttcgggtaccggggg

SEQ ID NO: 340368 - DNA, 699 bp, Homo sapiens
  misc_feature: GZ8MTXP02HAY2G.17.10.A10.1.454.CMB.2.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaanaaaatntggtatgtaagttgggtncgacacggcccccgganaagggcttggagggttgggggtggggtgggtcagggtcggtcgttttagggaacggggttaaggcctaaacgtaggtacgtcggaccccgaaccggaagtagtaggggaaacggggcaaagggtacgttaccgaaaccggtaaacgtttaaccccgaaaccggggtaaccccaaccccccgtaacgaaaaccgtaaccgaaccgtactaaccgaactacgtaaccaaccgtagaccggaacgaccgtagacggagacgtacggacgaccgaacccgggtacggttacctacgttactacggtggtaccgaagtagttacgttttcgtacgtcgtactacggttaactacgttacgtagtacgtccgttgtacgtacggtacgtacggtacgttacggtccggggg

SEQ ID NO: 340369 - DNA, 638 bp, Homo sapiens
  misc_feature: GZ8MTXP02GH3KZ.17.10.A10.1.454.CMB.2.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (465)..(465): a, c, t, g, unknown or other
  misc_feature (465)..(465): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatntcttcaanaaaatntggtatgaatgggtncgacgacggcccccgagaacggctttggaggtggggtaggggtggtacgaggtcggtactttagggaacgggttaaggcaacgtaggtacgttgaccccgaaaccggaagagtacggaaaggggccaagggacgtacacggtaacttacccgaaccggaccctaacccccgaagaaaccacgacgtactacanacgtacaaacgtcgaacacgacccttagaaggaacgcgtacggaacgaccgtacgggtcctaaccgttataccgtggtcgacgtagtactttggtttccagttccagttaccgtagttaagttacgagttaggcttactaacgtggtactacgggtacttcgggtaacggggg

SEQ ID NO: 340370 - DNA, 707 bp, Homo sapiens
  misc_feature: GZ8MTXP02IIB47.17.10.A10.1.454.CMB.2.raw
  modified_base (247)..(247): a, c, t, g, unknown or other
  misc_feature (247)..(247): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggcagtgatatatctnaacaaaatatggtatgtagttggtgcgacgacggcccccgagaggcttggaggtgggtaggggtggtgaggtcggtcgtttagggacggtaaggcaacgtagtagtcgaccgaccgaagagtaggaacgggtnaacggngtaccgaacgtaaccgttaacccgaacccggaacccaaccccccgaaacggaaaccaacgtaacggtaccctaacgaacgttacgaccgtaaacgttacgaaaccggaagtaccccgtaggaaacggtacggccgttaacgggaaaccgtaccggaccgggtacccgttacgttaacgtttaacgtcggtaaggtaccggtaagtaaacgttttcgttttactacgttacgaactttacgtaaaacttacgtttagtaattacggtaaccttagttaaagtccggtaacgtttacggttaaccgttttcggaacccggggg

SEQ ID NO: 340371 - DNA, 656 bp, Homo sapiens
  misc_feature: GZ8MTXP02GMIW2.17.10.A10.1.454.CMB.2.raw
  modified_base (327)..(327): a, c, t, g, unknown or other
  misc_feature (327)..(327): n is a, c, g, or t
  modified_base (501)..(501): a, c, t, g, unknown or other
  misc_feature (501)..(501): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgacttgtctcctgcaaggccagtgatatatctacaacaaaatgtgtatgaagttgggtgacgacgaccggccccgacgaaggtcttggagggtggggtggggtggtcgnggtcggtccgtttagggaacggttacggcgaacgtaggtacttgacccgaaaccggaagaggtaggaaggggcaagtgtaccgaacgtaaccgttacccgaacccgggaaccccaacccccgtaagaaacccacgtaccgtactaacgatacgacaccgtagacgctcgtaganaggactaggaccgaccgacgggtcctaagttcgttacgtggtcgacggtaattacgtttcgtttcgtagttaccgtagttaacgtaaacgtttaacgttagtaccgtagtaaccgttagttaacgaggttaccgtggttacgtttcgggacgggg

SEQ ID NO: 340372 - DNA, 736 bp, Homo sapiens
  misc_feature: GZ8MTXP02GHB8P.17.10.A10.1.454.CMB.2.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacacggcccccgganaagggctttggaggtggggtggggtgggtcaggcggtcgtttgggacggtaaggcacgagtagtgaccaccgaagagtaggaaggggcaaggacgtcgaacgtaacttacccgaacgggacccaacccccgaacgaaaccacacgtacctaacaagtcgaccaaccgtaggaaccggacgacccgtaggaacggtaacggccttacgggaacccggaccgacccgggggtaccccgttaccgttaaacgtttaaccgtgggtacggtacgttaacggtaaacgttttcgggtttttaccctagggtttaccctaagtttacccggttaaaaccgtttaaacgttttacgggtaaagttttaaccgggggtcctttacggttaacggttaccggggttaacgtttaccgggggttaaccgttttcccggggtttaacccggggggg

SEQ ID NO: 340373 - DNA, 637 bp, Homo sapiens
  misc_feature: GZ8MTXP02FU935.17.10.A10.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (459)..(459): a, c, t, g, unknown or other
  misc_feature (459)..(459): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgacaggccagtggatatatctnaacaaaatntggtatgatgggtgcgacacggccccgganaaggcttgaggtggggtggggtggtcaggtcggtcgtttaggacggtaaggcacgagtagtgcccgaaccgagacgtaggaagggaccaaggcggtaccgaaaggtaaccgttaacccgaccgggaacccaaaccccccgaagaaacccacgtaacgttacaacctaanacgacaacgcgaacgcgaccgagacgacgacgtacgaccgtaccgaccggtacctacttagttacgtggtacgacgtaagttacgtttgttaccgtgtacgtaacgtacgttactaagttacgacgttacgtaacgttacgttaggtacggtacgtacggtccggttacggtacgggg

SEQ ID NO: 340374 - DNA, 566 bp, Homo sapiens
  misc_feature: GZ8MTXP02GGIJR.17.10.A10.1.454.CMB.2.raw
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (438)..(438): a, c, t, g, unknown or other
  misc_feature (438)..(438): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtgatatatcttcaacaaaatntggtatgaattggggtagcgacacggcccccgganaaggcttgaggttggggtggggtggcgaggcggtcgtttgacgggtaggcacgagtntcgccacgaagatggaaggcagngtcacgataccacggaccacccaagacacagacacatgacactacgaacgagtccagagacgntacgacgacacgggactacctagttacgtagtgacgagtaactttgtttctagttacgtattacgaacttagttacgagttacggtctacgttacgtacggacgttacggtacgttcggtaccggggg

SEQ ID NO: 340375 - DNA, 646 bp, Homo sapiens
  misc_feature: GZ8MTXP02HXK63.17.10.A10.1.454.CMB.2.raw
  modified_base (248)..(248): a, c, t, g, unknown or other
  misc_feature (248)..(248): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttccagttggtgcagactggggctgaggtgcagaagccgtggggcatcagtgactgtctcctgcaaggcagtggatatatctnaacaaaatatggtatgaagttgggtgcgacgacggcccccggaagaagggtcttggagggtggggtcggggtggtacgaggcggtcgtttggacggtaaggcacgtacgtagtgacccgacgaagagtagggaaggcgaggtgtacgaacgtactaccgaaccggacccaacccccgacgaaaccacgacgtacgtacagtgaccaacgtacgaccggaacgcccgtaggaacggcgcgtacggaaccgaaccgacccggggtcccttacgtacttacgtcggtagaccgtaagtaacgtttcgttttctacggttcgtaacgttacgttaaacttagtttacgaagttacggtaactacgttagtacggtacgttacggtaccgtttacggcggggg

SEQ ID NO: 340376 - DNA, 713 bp, Homo sapiens
  misc_feature: GZ8MTXP02GZZDZ.17.10.A10.1.454.CMB.2.raw
  modified_base (594)..(594): a, c, t, g, unknown or other
  misc_feature (594)..(594): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgacaaggcagtggatatatcttacaactaaaatatggtatgtaagttgggtgacgacgacgggacccccggagaagggtcgttggagggttggggtggggtgggtcgagggcggtcgtttagggaacgggtaaggcgaacgagtagtgacccgaaccggaaagagtagggaaggacgaaggacgtaccgaacgtaacttaacccgaccgggaacccaaccccccgaacgaaaccactacgtactaacgagtacgacaaccgtcggaacgtacgacccgtaggacgtacgcgtacggaaccgaaccgtaccggggtaccctaacgttacgttacgtcggttacgacgtaagttaagttcggtttttacncgttaaccgtaacgttacccggtttaaacttagttttacggaacggtttacgtaacgtttaccgttaaggttacggtaaaccggtttccgggttaaccgtttcggggtaacccgggggg

SEQ ID NO: 340377 - DNA, 746 bp, Homo sapiens
  misc_feature: GZ8MTXP02IP7LP.17.10.A10.1.454.CMB.2.raw
  modified_base (250)..(250): a, c, t, g, unknown or other
  misc_feature (250)..(250): n is a, c, g, or t
  modified_base (332)..(332): a, c, t, g, unknown or other
  misc_feature (332)..(332): n is a, c, g, or t
tcagcgtagactagcacgaccggtgctcgatttagcgtcgatctcaggggacccaaaaaccacacccctccttgggagaatcccctagatgacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttanaacaaaatatggtatgtaattgggtgcgacgacggcccccgacgaggggcttggaggttggggtggggtggtcgaggcggtntttaggacggtaaggcacgtagtagtgacccgtaccggaagtagtagggaaacggggcaaagggtacgtacgtaacggtaaacttaacccccgaccggggtaaacccccaacccccccgaaaacggaaaccctaaaccgtaaacggtacccttaaacgacgttacggaaccctaaaccgttacggaacccgaacggcccgttagggaagacggtaccttacggaacccgaccgtaacccgggtacccgttacttaacgtttaacgtcggttaggacccgttaaaggtaacgttttggtttttaccgtaacgttcgtaaacgtttacccggttaaactttacgtttaacgtaaagtttcgggtaacttacgtttagtacggttacggttacggttccgttaccggtttacggggg

SEQ ID NO: 340378 - DNA, 555 bp, Homo sapiens
  misc_feature: GZ8MTXP02JS9PP.17.10.A10.1.454.CMB.2.raw
  modified_base (371)..(371): a, c, t, g, unknown or other
  misc_feature (371)..(371): n is a, c, g, or t
  modified_base (442)..(442): a, c, t, g, unknown or other
  misc_feature (442)..(442): n is a, c, g, or t
  modified_base (494)..(494): a, c, t, g, unknown or other
  misc_feature (494)..(494): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggcagtgatatatcttcaacaaaatatggtatgaattgggtgcgacacggcccccggagaagggcttgaggtggggtggggtgggtcgaggcggcgtttggacggtaaggcacagtatgccaccgaagataggaagggcaggngtcacggtacttaccgacggaccacccccacgaaacacacgtctacatgacactagacgagccgtgaacgngacaggaccgacgacggaccgtacgtattacgtgtgcgagtattcgttttcngtcagtcgtactagttgattaggtcttacgtagtacggtacgtcggtactttcggacgggg

SEQ ID NO: 340379 - DNA, 533 bp, Homo sapiens
  misc_feature: GZ8MTXP02FIGBF.17.10.A10.1.454.CMB.2.raw
  modified_base (248)..(248): a, c, t, g, unknown or other
  misc_feature (248)..(248): n is a, c, g, or t
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttanacaaaatatggtatgaattgggtgcgacaggcccccggacaagggcttgaggtgggtggggtgggtcgaggcggctttgacggtaaggcacagtatgccaccgaagatggaagggcagagtcacgattacccgacggacacccccacgaaacacaagtctacatgacaacgtgaacgagaccctgagagctgacacaacgggccgtactaatttacctgtagcgaagaattgtttactgttcatcgtanatttgattagctntactgactcggacgttcgcgggg

SEQ ID NO: 340380 - DNA, 671 bp, Homo sapiens
  misc_feature: GZ8MTXP02IG5T2.17.10.A10.1.454.CMB.2.raw
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacaccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgacaggcagtgatatatcttacaacaaatattaggtatagtaagttgggtacgcgaacgaccgggacccccggaacgaacgggtcgttggagggttggggtggggtggtcgaggtcggtacgtttgggaccgggtaaggcaacgnggtaatgacccacgagagtaggaagggcagcgtacaacgtacgtacccgacggacccacccccgaaacgaaccacgacgtactacagtacgacctaaacgtcgaaaccgtgtacccgtaggaacggtacggaccgtacggaaccggtacccgtaccggggtcccttacgtaactttaccggagtacgggacgttaagtaacgtttcggttttacgtacgtactacgttaaccggttaacttagttaccgtaagtacgtcttcgtaaggtaccgtagtaccggttacgtcgggtaaccgggg

SEQ ID NO: 340381 - DNA, 549 bp, Homo sapiens
  misc_feature: GZ8MTXP02FGS4X.17.10.A10.1.454.CMB.2.raw
  modified_base (373)..(373): a, c, t, g, unknown or other
  misc_feature (373)..(373): n is a, c, g, or t
  modified_base (490)..(490): a, c, t, g, unknown or other
  misc_feature (490)..(490): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattggggtgcgacacggcccccggacgaagggcttgaggtggggtggggtgggtcgagcggcgtttgacggtaaggcacagtatgccaccgaagatggaagggcaggngtcaacgattaccgacggacacccccacgaaaccacagtctaacatgacaactgaaccgagaccctgagagctgaccgacacgggccgtctagttacgtgtgcgagtattgtttacngtcacttacgtactaagtttgataggctacgtagtcggtacctgggacttcgtcggggg

SEQ ID NO: 340382 - DNA, 602 bp, Homo sapiens
  misc_feature: GZ8MTXP02G12LJ.17.10.A10.1.454.CMB.2.raw
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (450)..(450): a, c, t, g, unknown or other
  misc_feature (450)..(450): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtgatatatcttcaacaaaatatgtatgaattgggngcgacacggcccccgganaagggcttgaggttggggtggggtgggtnacggcggtcgtttggacggtaaggcacgagtatgcccacgtaagacgtgaagggcagtggtcaacgatacccgacggacaccccacgaaactnaacgtctaacatacgacaaccgngaacagcccagaaagngacgtagacgacgaccggtaccgtactacgttacgtgtacggtacgtagtaactttcgtttacgtcgtactaacgttacgttaaacttacgtttacgtagttacggtcgttacgtaacgtacggtacgttacggtaccgttcgggtacgggg

SEQ ID NO: 340383 - DNA, 647 bp, Homo sapiens
  misc_feature: GZ8MTXP02HWC1Y.17.10.A10.1.454.CMB.2.raw
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatatcttacaactaaaatataggtatagaagttgggtgacgacgaccggcccccggagaagggcgttggagggtggggtggggtggtcgaggtcggtcgtttggacggttaaggcagagtatgaccgacgaagntaggaaggnagacgtcgaagacttaccgaacgacccaccccaacgaacacacgtctacatcgacaactcggacgcgtacctaggacgacgtcgtaacggaccgaccgtaccgggtcccgttacttaacgttacgttggacgtaccgtagttaaacgttgttttacgtacgttctaacgttaccggttaactttaagtttacgtaacgttacgttaacccgttagtaacgttacggtacgttacgggttacccgtttcggggtacccggggg

SEQ ID NO: 340384 - DNA, 543 bp, Homo sapiens
  misc_feature: GZ8MTXP02IFEGX.17.10.A10.1.454.CMB.2.raw
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctcgcggcccccgganaggaggtcaccatctctgctctcgaacccccatgtgatcatatgtntctgtacngacacgtccggatcaccgaccccaaactcctacaatactatagaagataataacnccgtaccctcgtacggggttcccacgaccgtatctctcggctcgagtctcgctacgtctcgaccacccgtgaccatccaccgcgctccgagacgtgggacacggcgtagttactttcgngccganactagtggacttcaagtcctagcgttcggtgggtgttaccggcgtacggtacgacgtacgtcgtacgtaaccgtcgtacggacacgacccgtacgccgtcccg

SEQ ID NO: 340385 - DNA, 612 bp, Homo sapiens
  misc_feature: GZ8MTXP02HZ1ZW.17.10.A10.1.454.CMB.2.raw
  modified_base (274)..(274): a, c, t, g, unknown or other
  misc_feature (274)..(274): n is a, c, g, or t
  modified_base (325)..(325): a, c, t, g, unknown or other
  misc_feature (325)..(325): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtncgacacggccccggagagggtctggaggtggggtggggtggtcgaggcggngtttggacggtaggcacagtatgccacgagagtcggaagggcagcgtacacgacttacccgaccgggacccacccccgaagaaaccacacgtacaacgatagacaaacgtgaaccgacggaccctgacgaggctacgggaccgaccgaccggtccgtactattacgtgtacgagtaacgtaatttcggttttctagttacctacgttaccgttaaacgttactttaggtacgttacggtcttacgttagtacggttacgtcggttaaccgttcggggtacccggggg

SEQ ID NO: 340386 - DNA, 667 bp, Homo sapiens
  misc_feature: GZ8MTXP02I0WIN.17.10.A10.1.454.CMB.2.raw
  modified_base (241)..(241): a, c, t, g, unknown or other
  misc_feature (241)..(241): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctctgcaggcagtgatatntcttcacaaaatatgtatgtaagttgggtcgcgacacggcccccggacgaaggcgtttaggaggtggggtggggtagggtccgaggcggtcgtttaggacgggttaaggccaacgtagtagtcgaccccgtaccggaaggtagtaggaacggggtacgaggtaggttaccaacggtaaacgtttaccccgacccgggggaaacccaccccccgaaacgaaaaccgaaacgttacctaacaacgtcaacaaacgtcgaacgacgccgagagagcgtagacgacgaccggcgtactagttacgtgtaggacgtacgtaagttcgttttacgtagttcgatttaccgtaaattaagttttacgagttacggtacttaacgttacgttacggtaacgtggtttaccgttcggggtacgggtaacccgggg

SEQ ID NO: 340387 - DNA, 689 bp, Homo sapiens
  misc_feature: GZ8MTXP02IT0G4.17.10.A10.1.454.CMB.2.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtgggctggaggtgcagagccgtgggcatcagtgactgtctcctgcgaaggcagtgatatatctacaanaaatgtggtatgtaagttggngcgacgaccggacccccgaagaagggtcttggagggtgggggtggggtggtaccgaggtcggtcgtttagggaacggtaggaccaagagtatcgaccaaccggagagtaggaaggcgaagtacggtacgaaacgtaacgttacccgaaccgggaacccaaacccccgtaagaaacctacgacttacaacgaatcgactacgacgacgaacgccgagaacgtacgaccgaggaccgaccggaccgggtaccgttaccttaaagtttccgttacggacggtaacggtaaagtttaattcccgtttttaggtacgtttacgttaacttaaccggttaaatttacgttttaacgggaaattcggtaaccctttagttaggtacggttaaacgtcggttacggttttacggtaacccggggg

SEQ ID NO: 340388 - DNA, 708 bp, Homo sapiens
  misc_feature: GZ8MTXP02GLEYQ.17.10.A10.1.454.CMB.2.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccaggtggatatattcttacaaactaaaattataggtataggtaagtttggggngacgacgacgggaccccccggagaaggtcgttaggagggtggggtggggtggtcgaggtcggtcgtttagggacggtaaggtcaacgtagtactgacccaaccggaagtagtaggaacggggaccaagggtcgtaccgaaaccggtaaactttaaccccgaacccgggaaccccaaaccccccgaaacgtaaaccgaacgaacggttaccaaaccagttccggaaaccctaacgttaaccggacgaaaccgcccgttagaaacggcgtacgtacgaacgaccggtaaccgggtctacccgttatacgtggtacgagtacggtaatttcgtttaccgtggttacttactacggttaaacttagtttacgagttaacggtctacttaggtacggtactacggtacgtttccggtaacggggg

SEQ ID NO: 340389 - DNA, 599 bp, Homo sapiens
  misc_feature: GZ8MTXP02JMQYK.17.10.A10.1.454.CMB.2.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (367)..(367): a, c, t, g, unknown or other
  misc_feature (367)..(367): n is a, c, g, or t
  modified_base (424)..(424): a, c, t, g, unknown or other
  misc_feature (424)..(424): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgccccaggttcagttggtgcagactggggctgaggtgcagaagcctggggcatcagtgactgtctcctgcaaggccagtggatatatcttcacaaaatatggtatgaattgggtncgacacggcccccgganaagggcttgaggtggggtggggtggtcaggcggcgtttgacggtaggcacgagtatgccaccgaagatagaaggcagngtcagattaccacgacacccccagtaaccacagtactacatcgacaaccgtgacganccgtagaagagactgaaccgaccgtacgggaccgtacttaagttaccgtgtcgaccgtaagtaagttcggttttactaggttacctagttacgttaaactaacgtttttacgaacgttaaggctttaccgtaaggttacgggtaccttagggttaaccctttcggtaaccggggg

SEQ ID NO: 340390 - DNA, 626 bp, Homo sapiens
  misc_feature: GZ8MTXP02FN6EA.17.10.A10.1.454.CMB.2.raw
  modified_base (331)..(331): a, c, t, g, unknown or other
  misc_feature (331)..(331): n is a, c, g, or t
  modified_base (467)..(467): a, c, t, g, unknown or other
  misc_feature (467)..(467): n is a, c, g, or t
  modified_base (478)..(478): a, c, t, g, unknown or other
  misc_feature (478)..(478): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacacggcccccggagaagggctttaggaggtggggtggggtgggtcaggtcggtntttaggacggtaaggcacagtatgaccaccggaaagagtaggaaaggggcaaggacgtacaacgtaattaacccgaacgggaaccaaccccccgaagaaacacaacgtactaacatagacaaactgacgagtaccngaagagtaccnggaaccgacacgggcctactattaacgtgtacggcgaaagtaacttcgttttctagttctaacgttacgtaaccttaaacgttttcgaagtttaggtaacttaccgttaaagtacggggtacttacggtaccgtttccggtacggggg

SEQ ID NO: 340391 - DNA, 666 bp, Homo sapiens
  misc_feature: GZ8MTXP02FV7WU.17.10.A10.1.454.CMB.2.raw
  modified_base (259)..(259): a, c, t, g, unknown or other
  misc_feature (259)..(259): n is a, c, g, or t
  modified_base (350)..(350): a, c, t, g, unknown or other
  misc_feature (350)..(350): n is a, c, g, or t
  modified_base (485)..(485): a, c, t, g, unknown or other
  misc_feature (485)..(485): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaggccagtggatatatcttacaacaaaatntaggtatgaattgggtgcgacacggcccccggagaagggctgaggtgggtggggtggtcaggcggtctttggacggtaaggcacgagtagngaccgaccgagaataggaaggggcaagagggtccaacggtaacttaaacccgaccgggaaaccccaaaccccccgaagaaaacccaacgtacgtctaaacgacttcggaacaaaccgttaggaacgacgtaccgnggaaacgacgctacggaaccgacccgaaaccgggggtcccttaaccgttatttaacgtcggttacgacgggaaattaagtttcggttttacctgtttaacacgttacggttaaacttagttttagaagtttaacggtcgttacttagtcggtaacgttcggtacgtttacggtaccggggg

SEQ ID NO: 340392 - DNA, 702 bp, Homo sapiens
  misc_feature: GZ8MTXP02JHJJ7.17.10.A10.1.454.CMB.2.raw
  modified_base (255)..(255): a, c, t, g, unknown or other
  misc_feature (255)..(255): n is a, c, g, or t
tcagcgtagactagcacgaccggtgctcgatttagcgtcgatctcagtggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtgggcatcagtgactgtctctgcaagccagtggatatatcttacaactaaatntaggtatagtaagttggggtagcgacgacgggaccccccggaagaaggggtcttagggaggttgggggtggggtaggtcgaggcgggtcctttgggaacgggttaaggccaacgaggtactcgacgaaccgaagacgtaggaaggacgagaacgtacgaacgtacgttaaccgaacccgggaaccaacccccgaaagaaacccgactaaccgtaccgtaaccgaatacggaccaaacgttcgaacggacgaccgtagagacggtacgcgaaccggaccgacggtacccgttactaacgttaccgtggtacggtcgtaagtaatttcgggtttacttcggtaaaccttacgttaaacggtttaaacccgtaaggttttaccgtaaaggtaacggttccttaacgttacgggtacggttacggtttacccgggtaagtttacccggggg

SEQ ID NO: 340393 - DNA, 722 bp, Homo sapiens
  misc_feature: GZ8MTXP02F30YO.17.10.A10.1.454.CMB.2.raw
  modified_base (260)..(260): a, c, t, g, unknown or other
  misc_feature (260)..(260): n is a, c, g, or t
  modified_base (328)..(328): a, c, t, g, unknown or other
  misc_feature (328)..(328): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactggtctccgtgcaaggccagtggatatatcttacaacaaaatntggtatgtaattgggtgcgacacggacccccggagaaggcttgaggtgggtggggtggtcaggcggtntttggacggttaaggctaacgagtagtgaccctaaccggaagacgtaggaaaacgggcaagggtagtccgaacgtaattaacccccgaaggggaaccccaacccccgaacgaaaccgaacgtacggttaacctaaacgattaggaaccaacttacggaacgtaacggaccttaggaaacggagaccggttacggaaccgggaaccgtaaccggggtaccttaccggtaaactttaaccgtcgggtttaggaccggtaaacggtaaacgtttgggtttttaccctaggtttaaacccttaggtttacccggtaaacttaacgtttttacggaacgttacggtaaccttagtacgttaacggtccgttaaggtacccggtttcgtaacccgggggg

SEQ ID NO: 340394 - DNA, 705 bp, Homo sapiens
  misc_feature: GZ8MTXP02ISIA7.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcgagtgactgtctcctgcaaggcaggtggatatatcttacaaactaaaatagtggtaatggtaaagttgggtgacgaccgacggcccccggaagtaagggcttggagggttgggggtggggtgggtacagggtcggtctttagggaacgggtaaggcctaagagtagtcggacccaacggaagagtaggaaggacagagtcaacgtactacccgaacggacccaaccccaacgaaacacgtacgtaccaacgatacgaacaacgaggaccgacgtaccgtaggaaacgagtccgtaacgggacccgacggacccgggtaccgttaccttaagttacccggtgggttacgacggtaaagttaacgtttggttttacccgtagggtttactaaccggtttacccggttaaaactttaagttaccggtaacgttaagggtccttaacgtaggttacgggaaacgtttacgggtccgtttacggggaacccggggg

SEQ ID NO: 340395 - DNA, 690 bp, Homo sapiens
  misc_feature: GZ8MTXP02FK0GP.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcgagtgactgtctccgtgacaaggccaggtggatatatacttacaactaaaatgtagtatagaagttgggtgacgacgaccggccccggaacgagggcttggagggtggggtggggtggtgaggtcggtcgtttacggacggtaaggcgaacgtagtacgtgacccgaaccggaagagtagggaacggataggacgtcaaacgtacgttaccgaacccgggaaccaacccccgaaacgaaacccagtacgtactaactactacgaactacgacgaacgaacgtccgtaaggagtacgaggtacggaccgaccgtacgggtaacccgttactagttaccgtggtacggtacggaagttttagtttacgtttccctaggttaccctaaagtttacccgaaattttacgtttaacggagttaaacccgtgttaacttacggtcggtagttaccgggtttaacgtcggggtaaacccgggg

SEQ ID NO: 340396 - DNA, 632 bp, Homo sapiens
  misc_feature: GZ8MTXP02F2WTP.17.10.A10.1.454.CMB.2.raw
  modified_base (292)..(292): a, c, t, g, unknown or other
  misc_feature (292)..(292): n is a, c, g, or t
  modified_base (384)..(384): a, c, t, g, unknown or other
  misc_feature (384)..(384): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggcagtgatatatcttacaacaaaatataggtatgaattgggtgcgacgacggcccccgganaagggcttggagggtggggtggggtgggtcgaggcggtcgtttggacgggtaaggcaacgagtatgaccaccgaagagtaggaagggcaggngtcacgtattaccgaccggaaccaacccccaaagaaacaaagtcctaacgatacgacaactgacgacgaccgtagagacgacgtacgaaccgacgtacggtaccggttactaacgttacgtacgtcggacgtagtaaagttttcgtttacgtacggttactaattaccggttaacttaacgttttacgaatacggtacttaacgtagtacggtacgttacggtaccgttcggtacggggtaacccggg

SEQ ID NO: 340397 - DNA, 654 bp, Homo sapiens
  misc_feature: GZ8MTXP02JVCUB.17.10.A10.1.454.CMB.2.raw
  modified_base (493)..(493): a, c, t, g, unknown or other
  misc_feature (493)..(493): n is a, c, g, or t
  modified_base (515)..(515): a, c, t, g, unknown or other
  misc_feature (515)..(515): n is a, c, g, or t
  modified_base (545)..(545): a, c, t, g, unknown or other
  misc_feature (545)..(545): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtgggcatcagtgactgtctcctgcaagccagtgatatatcttacaactaaaatgtgtatgtaagttcgggtgcgaacgacgggacccccggagaacgggtcttaggagggtggggtggggtcgggtcgaggtcggtcgtttgggaccgggttaaaggcaacgtagttagcggacccaaccggtaagattagggaagggacgaagtacgtacgaaacggtaacttaacccgaaggggaccccaaacccccgacggaaacctacccgaaggttcaacgactcgactaacgngaacgtaacgcctagaacggcncgtacgacgacgtcggactactacgttcgnggtacgagtagtagtttcgtttacttacgtactacgtacgttaacgttaacgttacgtaagtacgtaacgtacgtacgtacggtacgtacggttacgttacggtacggg

SEQ ID NO: 340398 - DNA, 683 bp, Homo sapiens
  misc_feature: GZ8MTXP02GRMG3.17.10.A10.1.454.CMB.2.raw
  modified_base (261)..(261): a, c, t, g, unknown or other
  misc_feature (261)..(261): n is a, c, g, or t
  modified_base (513)..(513): a, c, t, g, unknown or other
  misc_feature (513)..(513): n is a, c, g, or t
  modified_base (572)..(572): a, c, t, g, unknown or other
  misc_feature (572)..(572): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgacaaggcctagtggatatatcttacaacaaaatntaggtatgaagttgggtgaccgtacgacggcccccggaagaacgggctttaggacgggttggggtagggggtggtcgacggtcggtcgtttagggaaccggtaaggccgaacgtaggtagttcggacccgaacccgggaaagagtaggaaacggggtcgaaggtacggtaccaacggtaaacgttaccccgaaccgggaacccaaaccccccgaacggaaacaccgtaacgtactaacgagtcgactaacgngaacgacgccgtggaacgtgcgtacggaccgaccgtacggcccgttactacgttaacgnggtaaccgggtaacgtaagtttcgtttactcggttatacgttacgtacttaagttacgaagttacggaaccttaggtacgtacgtacgtacggtcgtttacggtccggggg

SEQ ID NO: 340399 - DNA, 777 bp, Homo sapiens
  misc_feature: GZ8MTXP02F0G2F.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcagaacgccgtggggcatcagtgactgtctccgtagacgaggccaggtgtatatattcttacaaataaaattagtaggtataggtaagttgggacgacgacgaccggcccccggagaggtcgtaggagggtggggtggggtggtcgaggtcggtcgtttagggacggtaggctacgagtagtcgacccgaacggaagaggtacgggaagggacgtagggtacgtaccgaaccggttaaccgtaacccccggaacccgggtaaacccccaacccccccgggaaacaaacccgtaacccgtaacggtttacccaaacgtaacgtacgaaacccgaaccggttacggaaccgtacccgaacgtggaaaggaccgtaccggacggaacccgaaccgtacccggggtaccttacgttaacgttaccggtagggtacggtaacgttaaggtttacgtttcgttttacgtaccggtacttacgtttaaaccgttaacggttagttttaacggtacgtttacggtaaccgtttaggttacggttacgggttacggtttacggggtacgtttaccgggggacccggggg

SEQ ID NO: 340400 - DNA, 704 bp, Homo sapiens
  misc_feature: GZ8MTXP02GWGVX.17.10.A10.1.454.CMB.2.raw
  modified_base (656)..(656): a, c, t, g, unknown or other
  misc_feature (656)..(656): n is a, c, g, or t
tcagcgtagactagcacgaccggtgctcgatttagcgtcgatctcaggggacccaaaaaccaccacccctcccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatacatcttcaacaaaaatataggtatgaaattggggtggcgaacgacggcccccccggaagaaaggggctttggagggtggggtagggggtgggtcgaggcgggtcgtttaggacgggtaaagggcaacgagttagtcgacccgaaccggaaaggtaagtacgggaaaggggaccgtaaggacggtaccaaaccggtaacgtttaaaccccgaaaccgggaccccaaaccccccccaaaccgggaaaacccaccgtaaggtaccttaaaccattcggacaaacgtacggaacgagacccgtggaaagacgccgttaggacgaaccgaaccggggtcctacttagtttacctaggttgcggaaagtaagtttagttttccttggtactacttacggttaactaaacttttacggngttaaggtcgtactaacgttaggaccgttcggaccgttgtaccggggg

SEQ ID NO: 340401 - DNA, 778 bp, Homo sapiens
  misc_feature: GZ8MTXP02FR646.17.10.A10.1.454.CMB.2.raw
  modified_base (344)..(344): a, c, t, g, unknown or other
  misc_feature (344)..(344): n is a, c, g, or t
  modified_base (519)..(519): a, c, t, g, unknown or other
  misc_feature (519)..(519): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaacgccggtggggcatcagtgactgtctccgtgacgaggccagtgatatatcttacaactaaaatgtaggtatagtaagttgggtgcgacgaccggtacccccggaagaggtcgttaggagggtggggtggggttcgggtacgnggtcggtcgtttacgggaacggtaaggcaacgtagtacgtcgacccgtaacggaagtacgtagggaaacgggcaagggtacgtaccgtaacggtaaccgttaacccgaaacccggggaaccccaaacccccgaaaccggaaaccgtaaaccgtacggttaacccaaacggttaanaccgggttaaacccaaaccgggttacggaacccggaacgtaccccgtaggggtaaaccgacgggtaccgttaaacgggaaccccggtaccggtaccccggggttaccttacgtttaaacgttacccggttgggtacccgtaaacggttaagtttaacgttttgggtttaaaccctggttaaccttaacggttaccgtaactttagtttacgacttggtaaccctagtagtcggtagtacggtcggttacggaccggggg

SEQ ID NO: 340402 - DNA, 801 bp, Homo sapiens
  misc_feature: GZ8MTXP02IZQXA.17.10.A10.1.454.CMB.2.raw
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (300)..(300): a, c, t, g, unknown or other
  misc_feature (300)..(300): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagcctggggcatcagtgatgtctcngcaaggccagtggatatatcttacaactaaaatnttaggtaatgtaagtttgggngcgacgaccggtacccccgganaaggggtcttggagggttagggggtcggggttggggtaccgaggtccggtacggtttttacggggaaaccggggttaacggaccgtaaacgtaacggtacgttacggaccccgaaacccgggtaaacgtaagttaggggaaaaccgggtaccgaaggggtacgtaccggtaaacggtaaaccgtttaaacccccggaacccggggttaaacccaaacccccccggtaaacgaaaaccgaccgttaacccgggttaacccaaaacgtcgttacgaaacccgtaaacgttacggaaccggtaaacgccgttaacggaggttaacgccgttacggaacgtacccggacggtaccccgttataccgtttagtaggttacgggacttaacggtatttcggtttttcccgagtttacgtacgttacttaaaccgtttacgttttaagaacgttacggtaaccgtttagtacgttacgggcgtttacggacggtttcggaaccggggg

SEQ ID NO: 340403 - DNA, 635 bp, Homo sapiens
  misc_feature: GZ8MTXP02JGIIU.17.10.A10.1.454.CMB.2.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggccagtggatatatcttcacaaaatntgtatgaattgggngacgacgacggcccccggagaacgggctttggaggtggggtggggtgggtcgaggcggtcgtttagggacgggtaaggcacgtagtacgtcgaccgaaccgaagacgtagggaagggtacgaaggacgttacgaacgtaacgttaacccgaccgggaacccaacccccgaacgaaaccacgacgtacaacagtgacaactgaccgagcctagagagcgtagaccgacgaccgggccttacgtaacttacgtgtacggacgtaagttaagtttcgtttttcgttacggttacctaacgttaccgttaacttaagttttacgattaggtcttcgtagtcgtacgtcggttaccgtggtaccggggg

SEQ ID NO: 340404 - DNA, 552 bp, Homo sapiens
  misc_feature: GZ8MTXP02GE5RV.17.10.A10.1.454.CMB.2.raw
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (461)..(461): a, c, t, g, unknown or other
  misc_feature (461)..(461): n is a, c, g, or t
  modified_base (482)..(482): a, c, t, g, unknown or other
  misc_feature (482)..(482): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacaggcccccgganaagggcttgagtggggtggggtggtcagcggctttggacgggtaaggcacagtangccacgagatggaagggcagngtcacgattaccgacgacacccccagaacacacgtactacatgacaacgtgacgagccagacggaagcaggacgacaccgggcctactagttacnggtgcgagtattgttttacgngtactacgtacgtaactagttcgacgtacgtcgttacgtagtcggtacgttcggtaccgttcgggtcggg

SEQ ID NO: 340405 - DNA, 895 bp, Homo sapiens
  misc_feature: GZ8MTXP02G41SA.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctggaggtgcagacgccgtggggcatcagtgactgtctctgcaggcagtggatatatctacaacaaatgtaggtataggaagttggggacacggaacgacccggacccccggaagtaacggggtcgtttaggacgggtttggggggtggggttcgggtacgtacggggtccgggttcgtttacggggaacggggttaacggccgtaaacggtaggttacgtccggaacccgaaaccgggaagtaggtaacggggaacggggtacaacgggtacggtaccgtaaaccggtaaaccgttaacccccggaacccgggaaacccccgaaacccccccgtaaaggtaaaacccaacccgtacggttaaccctaaaccgtaacggtaccggaaaccttaacggtacgggtaacccgtaacggaccgtacgggaacgaccggtttaccgtaaccgggtaaaccgggacccgtaaccccgggggttaccctttaacgttaaaaccgtttcccgggttaggtaaccgggtaaccgtttaaaaggggtttaaaccgtttttcggttttacccgttacgtttacccggtaaaaccggtttaacccgtttaaaacgtttaaacggttttcggtaaacgtttacggggtaaacctttacggtaacggttacgggtttaccggtttacggttaacccggggttttcggggaaaacccgggggg

SEQ ID NO: 340406 - DNA, 821 bp, Homo sapiens
  misc_feature: GZ8MTXP02GAVNI.17.10.A10.1.454.CMB.2.raw
  modified_base (779)..(779): a, c, t, g, unknown or other
  misc_feature (779)..(779): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtggggctggaggtgcagaacgccgtggggcatcgagtgactgtctccgtgacgaacggcaggtggatattagttcttacaaactaaaattagtggtaatagaagttggggtcgacgacgaccggacccccggaagaagggtcgttaggtaggggttggggtgggggtaggtcgaggtcgggtttacgtttagggtaaacggggtaaggacgtaacgtaaggtacgtacgaaccccgaaaccgaaaggaacgtaaggggaacgggtacgaagggtacggtaacctaaaccgggttaaacccgttaaaacccccggaaccccggaaacccccgaaaacccccccgaaacgaaaaacccgtaacggtaaacccgtttaacccgaaactaacgtttaccgaaaacccgttaaacggtaccggacgaaccgggcccgttaagggaaacgggttaccggaacgttaacccgggaacccggaacccgggttaacccggggtcccttaaacttagtttaccgggagtacggggtacctaaagtttcggtttactttcgaacgtttactacgtaaacgtttaagttacgttaggactttacggnttacggtgtaccggtgtttacggaccggtttggaaccggggg

SEQ ID NO: 340407 - DNA, 746 bp, Homo sapiens
  misc_feature: GZ8MTXP02IZ3DR.17.10.A10.1.454.CMB.2.raw
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtcctcctgcaaggccagtggatatatcttanaacaaatntgtatgaagttgggncgacgaccggacccccggagtaagggtctttaggagggttggggacggggttggtcgaggtcgggtcgtttttacgggaacggggttaaggcccgaaagttaggtacgttacgggaccccgtaaaccgggaaagtacggtacggggaaacggggccaagggacggttaccgaaacggggtaacttaaaccccgggaccgggaaccccaacccccgaacggaaaacctacgtaacgttaccaacgtactacggacctaacgtagaacgtagaccctagacgacgacgtacgaaacggtacccgtaaccgggtccgttaaccgttagtttaaccggtcggttagggaaccgttaaggttaacgtttcgggtttttacacggttactacgtttacggtaaacttaggtttacgaagttacggtccttttacggagttacggtaccgtttagtacccggttttcggaaccggggg

SEQ ID NO: 340408 - DNA, 759 bp, Homo sapiens
  misc_feature: GZ8MTXP02F88XG.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagagccgtgggcatcagtgactgtctcctgcaagcagtggatatatcttacaactaaaatgtaggtattaggtaacgttgggtgacgacgaccgggacccccggtacgaagggtcgttggagggttgggggtggggtggtcgaggtccggtcgtttagggaacggttaggacctaagagtacgtgaccccgaccggaagtagtaggagggcaaggcgtcgaacgtacgttaacccgaccggaacccacccccgaaacgaaaccacgtaccggttactaaacgacgttacgacctaaccgttacgggaccggttacgacccgttagggaacgacggaccgttacggaaccgtaaccgtacccgggtccgttaacgtttacgtttaacgtcgggtaaggtacccgtaaggtttaacgtttcccggtttttagtacggtttacctaacggtttacccggtaaacgttttaagtttaacggtaacgtttaaacgggttcttaaccggtttaagggtaccggtttaaacggtttcgggtaaccgttttccggggtaacccgggggg

SEQ ID NO: 340409 - DNA, 640 bp, Homo sapiens
  misc_feature: GZ8MTXP02GS6TM.17.10.A10.1.454.CMB.2.raw
  modified_base (217)..(217): a, c, t, g, unknown or other
  misc_feature (217)..(217): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtnactgtctcctgacaaggccagtgatatatctacaanaaatntgtatgatggtgacgacgacggccccgagaggctagnggtgggtggggtggtcgngcggtgttgaggtagcactgtatgaccgacgagagtaggaaggcaagtgtacgacgtaactaccgaaccggacccaacccccgaaacgaaaccacgtaacgtactaacagtacgactaacgngaacccgganccgaggaacgcgtacgtacggaaccgacgaccggggttaccctacgttaacgttaacggtggtaccgtaaggtagtttagtttacggtttcttaggtaacctagtttacgtaaacgttagtttaccggtaaagttacggaacctttagtaacgttacgggtaacgttcggttccggttacggggtaacccggggg

SEQ ID NO: 340410 - DNA, 602 bp, Homo sapiens
  misc_feature: GZ8MTXP02GE7QX.17.10.A10.1.454.CMB.2.raw
  modified_base (259)..(259): a, c, t, g, unknown or other
  misc_feature (259)..(259): n is a, c, g, or t
  modified_base (376)..(376): a, c, t, g, unknown or other
  misc_feature (376)..(376): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatntaggtatgaattgggtgcgacgacggcccccggagaagggcttaggaggtggggtggggtggtcgaggcggtcgtttggacggtaggcacgagtatgccacgaagagtggaggcagngtcaacgactaccgacggaccacccccgaagaaccacacgtacacatgacaactgaccgagccctagagagctagaccgacgaacgggcccgttactagttaccgtggttacgcggtaagtaacgttggttttactggtacctaacgttacgttaactaaacgtttggaaacttaggaacctttacgtagttacggacgttaggtaccgtttcggtaacccggggg

SEQ ID NO: 340411 - DNA, 635 bp, Homo sapiens
  misc_feature: GZ8MTXP02FZI28.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcaggaagccgtggggcatcagtgactgtctctgcaggccagtggatatatcttacaacaaaatataggtatgtaagttgggtagcgacgacggcccccggagaagggcttgagggtgggtggggtgggtcgaggcggtcgtttaggacggtaaggcacgagtagtgacccaccggaagagtagggaaggacaaggcgtacgacgtacttaacccgaccgaacccgacccccaacgaaaccaacgtaccgtactacgaatcgaccaaacgtgaacgacgtacgagagacgtacgtacggacgaccgaacgggtccttacgtagttactcggtgacggtagtaaagttgttttactcgttactacgttacgtaaacttacgtttagaacgttacgaagttccgtaagtcggtaccgttaggtaccgttcggttaaccggggg

SEQ ID NO: 340412 - DNA, 770 bp, Homo sapiens
  misc_feature: GZ8MTXP02HWHZY.17.10.A10.1.454.CMB.2.raw
  modified_base (322)..(322): a, c, t, g, unknown or other
  misc_feature (322)..(322): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcgagtgacttgtctctgacaggcagtggattatatcttacaactaaaatagtaggtatagtaagttgggacgacgacgaccggacccccggaagaagggtcgttaggnggggttacggggtggggtacggtacgaggtcggtacgttttacgggaacggttaacgacgaacgtaaggtagtacgaccgaaccggtaaagtcgtaacggaaggggtaccaaggtacgtaacgtaacgtaaccgttaacccccgaacggggacccccaaacccccgaaacgtaaccgtaaactaccggttaacctacgaacgtccgtaaacacggttaagaaccgtacgaccgtaggaacgcggtactaaccggaccgaaacggtacccgggtaccgttaacgttaacgttaccgtaggtacgtaccgtaaacgggtttagtttacggtttttacgtacggttaacttaccgttaacggtttaaacgttagtttaacgtacgttaacggtaacctttacgtaaggttacggttaacgttacggtttaccgtttacggggacccggggg

SEQ ID NO: 340413 - DNA, 653 bp, Homo sapiens
  misc_feature: GZ8MTXP02JHANJ.17.10.A10.1.454.CMB.2.raw
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (385)..(385): a, c, t, g, unknown or other
  misc_feature (385)..(385): n is a, c, g, or t
  modified_base (458)..(458): a, c, t, g, unknown or other
  misc_feature (458)..(458): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtnactgtctctgcagcagtgatntntcttnacaaatntgtatgaagttgggngcgacgacggacccccggagaacgggccgttggagggtggggttgggggtgggtcaggtcggtacgtttggacgggtaagcgaactaggtatgcccgacggaaagacgtagggacgganagacggtcaacggtacttacccgaacggacccaacccccgacgaaaccacgaacttcaacagtacgacaacgngacgagacccttgaacgagacgtacggaaccgaccgtaaccggggtccttacgttacgttacttcgggtacgtcggtaagtaacgttcgttttacgttcgttacgtaacgtttacgttaaaccggtattttaaaccgagtttaaacgtcgttaacgtaccgttggtaaccgtggttaacgttcggtaaccggggg

SEQ ID NO: 340414 - DNA, 638 bp, Homo sapiens
  misc_feature: GZ8MTXP02GMRVB.17.10.A10.1.454.CMB.2.raw
  modified_base (372)..(372): a, c, t, g, unknown or other
  misc_feature (372)..(372): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccggacaagggcttggaggtggggtggggtgggtcgaggcggtcgtttggacggtaaggcgacagtatgccacgaagagtgaaggcagngtcacgagtaccacggacaccccagaacacagtcacatagacacgtgacgagccgtgacgagactacggacgacgaccgggtccgtactaagtttaccgtggtcggaccgtaaggtaaatttcggtttttaacctgggtttacctaaacggtttaccgggttaaaaccctttaacgttttaaggtaacgttaaaggggttccccttaacgttaggttaccggggtaacgttacgggttaaccggtttccgggttaacccggggggg

SEQ ID NO: 340415 - DNA, 717 bp, Homo sapiens
  misc_feature: GZ8MTXP02GEQTP.17.10.A10.1.454.CMB.2.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctcctgcaaggcagtggatatatcttanaataaatatgtatgaagttgggngacgacgacggcccccggaagaaggcttaggacgggttggggaggggtggtcagggtcggtgtttagggacgggtaggcacgagtagtcgaccgaacggaagagtagggaaggggctaacggaggtaccgaacggtaacttaaccccgaccggaacccaaacccccgaacgtaaaccacgtacgttaccaacgaagtacgaaccacgtacgaacgacgtaccgtagaaaggcgagtacgggaacgtaccgggaaccggggtccctttaaacgttaacgtttacggttacggtacggtaccgggtaaacggtttaaagttttcggttttacccgtttggttaaaccgtaacgtttaaccggtttaaacttaagtttacggtaagttaacggtcctttaacggttagtacggtacgttacgggtaccgtttcggggaacccggggg

SEQ ID NO: 340416 - DNA, 554 bp, Homo sapiens
  misc_feature: GZ8MTXP02J0JHC.17.10.A10.1.454.CMB.2.raw
  modified_base (289)..(289): a, c, t, g, unknown or other
  misc_feature (289)..(289): n is a, c, g, or t
  modified_base (426)..(426): a, c, t, g, unknown or other
  misc_feature (426)..(426): n is a, c, g, or t
  modified_base (482)..(482): a, c, t, g, unknown or other
  misc_feature (482)..(482): n is a, c, g, or t
  modified_base (531)..(531): a, c, t, g, unknown or other
  misc_feature (531)..(531): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccgganaagggcttgagtgggtggggtggtcagcggctttgacggtaggcacagtatgccaccgagatgaagggcagagtcaacgattaccacggacaacccccagaacctacagtctaacatgcgaactgacgagcctgagngctgacgacacgggcctcgtattactgtggccgagaactgtttttcagtcctaaancgttaccgtaaatttcgaatttacggggaacttcgttaatcgggtaacncgggttaacgttcgttccggggg

SEQ ID NO: 340417 - DNA, 616 bp, Homo sapiens
  misc_feature: GZ8MTXP02FIN0Y.17.10.A10.1.454.CMB.2.raw
  modified_base (257)..(257): a, c, t, g, unknown or other
  misc_feature (257)..(257): n is a, c, g, or t
  modified_base (477)..(477): a, c, t, g, unknown or other
  misc_feature (477)..(477): n is a, c, g, or t
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtagggcagtcagtgactgtctctgacaaggccagtgatatatcttcaacaaatntggtatagaagttgggagcgacgacggacccccggagaagggtcttagagggtggggtaggggtggtacgaggtcggtgtttaggacggtaacggcacgagtatcggaccaccgagacgtaggaacgggcagcgtacacggtacttacccgacgacccaacccccgagtaaacgacacgtactaacacgtcggaacacgtacgaacgacgacgtgacggngacgtcgaaccgtcgaaccgggtcttactagttacgcggtacgaccaagttaacgttcgtttactggttactacgttacgtaactagtttacgagttacggctacgtagacggtacgttaggtacgtttcggaccgggg

SEQ ID NO: 340418 - DNA, 687 bp, Homo sapiens
  misc_feature: GZ8MTXP02HSNDA.17.10.A10.1.454.CMB.2.raw
tcagcgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtcgtctgccggccccggacaggaggtcaccatctcttgctctacggaaccccccagtgttggatctaatatgtgtcgtggtacagcaactccggatcacgccccaactcctcatactatagaataataaagtaacgaccgtaccctacggtacggggttcccctacggtaaccgtacttccttacgtcgggtcctacccgtaacgttccgtcggaccctaaccggttccttccggaccccgaaccccgttggggaccctaacgtcccgaacccggtcccgtcctacccggtaacggacccggtagggggaaccgacgggtaccggtaggtttacgtttccgtaggaccgtacgaaacgtagttacggggaactttccgacgtcccgttagtaccgtttcgggtcggggttcggttcggacgtacggggtacggaccgaaagtccggtacgtaacccggtttcgaacggggttccacgtacccgaaggcccctttccccgg

SEQ ID NO: 340419 - DNA, 670 bp, Homo sapiens
  misc_feature: GZ8MTXP02F4QM0.17.10.A10.1.454.CMB.2.raw
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaaggccagtggatatatcttacaacaaaatntaggtatgaagttgggagcgacgacggcccccggagacggcttaggngggtggggtggggtggtcaggtcggtcgtttagggacggtacggcacgagtagtcgacccgaacgaagagtaggaaggcaaggagtcaacggtactaaccccgaccgaacccaacccccgaagtaaaccacgtaacgactaaccagtacgacaaccgtaggaaccgtacgaccgtaggaacgtagacgtacggaccgaccgtacgggtcctacgttacgttactggtacgacgtaagttacgttttcggtttacttaggtacccgtagttaaccgttaaagtttaacgtttaggtaacgtttacggaaccgtttagtaacggttacggttaccgtacggttaccgttcgggttaaacccggggg

SEQ ID NO: 340420 - DNA, 711 bp, Homo sapiens
  misc_feature: GZ8MTXP02G3DL0.17.10.A10.1.454.CMB.2.raw
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (485)..(485): a, c, t, g, unknown or other
  misc_feature (485)..(485): n is a, c, g, or t
  modified_base (631)..(631): a, c, t, g, unknown or other
  misc_feature (631)..(631): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtgcccacgccctaggttcagttggtgctagacgtggggctggaggtgcgagacgccgtggggcatcagttgactgtcctctgacagccaggtgatatatctanaacaaatntggtatagtagtggtagcgacgccggaccccgagacggtctggagggtggggtgggtcggtgaggtcggtacgtttagggacggggtaagcgtacgtagtagtcgacccgtaacggagtaggagggacgggaccgaagtccgtaacgtacggtaaccttaaccccggaacccgacccgaaacccccgtacggtaaaccaacctaccggttaacaacgtacncgaaaccgtacggacgaacggacgtaccgagaacggacgaccggacccggtaaagccccggtaaccgggttacgtacgtttaaacggtccgttaggggtaaccccgttggtaaaccgtttttaggtccttttttaccgaaggtttntacccgtttaaaggtaccttagggtttacacggtacgttaacgttactacggtgtaacgtttcgtacgtacggtaaccgg

SEQ ID NO: 340421 - DNA, 604 bp, Homo sapiens
  misc_feature: GZ8MTXP02JVRRJ.17.10.A10.1.454.CMB.2.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (582)..(582): a, c, t, g, unknown or other
  misc_feature (582)..(582): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcagcagtgatatatctcaacaaaatntggtangaattgggncganacggccccganaggctgagtgggtcggnggnaggcgcgtttggaacggtagcagagtactgcctaaccgaagagtaggaacgggctaagngtccgaagtacgttacccacgggacccacccccaaggaacctacgagtcctaacgatcgacaaacgtgaaccgtagcccaggaagacggttacacgggaacgtaacgaacccgggtccgttacttaaacgttcctagggtaccgtacgggtaactaaagtttcgttttcgtaaacgttctacgttaacgtaattacgtttggaatcggtaactgttacgngtactcggacgtttcggacggg

SEQ ID NO: 340422 - DNA, 615 bp, Homo sapiens
  misc_feature: GZ8MTXP02G6P9S.17.10.A10.1.454.CMB.2.raw
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcagacacaggtgcccacgcccaggttcagttggtgcagacgtggggctgaggtgcagaagccgtggggcatcagtgactgtctcctgcgaagccagtggatatatcttacaacaaaatntgtatgaacttgggngcgacacggccccganaaggtctgaggtggggtggggnggtcaggtcggtnttggacggtagcacgagtngacccacgtanagtcggaggcaggcgtcaaacgtcgtacccaacgggaccacccccgaagtaaaccncgtactactaacgagtcgactaaaccggngaacgacgacgtagaacgtcgacgacggaaccgaccggtaccggtacttacgttaagttacgaggtacggacgttaagttactttcgttacgtacgtactaacgttacttaagttaacgttacgtacgttacgtcttagtacggttacggtacgtcggttacgtccggtacggg

SEQ ID NO: 340423 - DNA, 761 bp, Homo sapiens
  misc_feature: GZ8MTXP02GOOMQ.17.10.A10.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcagtcagtgactgtctcctgcaaggccagtggatatatcttnacaaaatntaggtatgaattgggngacgacgacggcccccggaacaaggggctttaggaggtggggtggggtgggtacaggtcggtctttaggacgggtaaggcaacgagtatgacccgaccgaagacgtagaaacggggcaaggcggtaccaacggtaacttaccgaaccggaacccaaccccccgaacggaaaccacgaacgtactaaccaatacgaccgtaaaccgtgaaccgaacgacccgttaaggaacggtaacgaccgtttaccggaaacgggaacccaacccgggggtaccccgtaacctttaaacgtttaaccgtcggttacggacccggtaaaggttaaagtttcgggtttttttacccaggggtttaacctaaacgttaccccgggtttaaaactaaaacgttttttacgggaaacgtttaaaaggggtccctttaaccgttaacgtttacccggggaacgtttacggggtaaaccgtttttccgggtaaacccgggggg

SEQ ID NO: 340424 - DNA, 703 bp, Homo sapiens
  misc_feature: GZ8MTXP02ISAE7.17.10.A10.1.454.CMB.2.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctctgcaggccagtggatatatcttacaactaaaatagttaggtataggtaagttggggtgaccggaccgaccgggtacccccggacgaacggggtcgttaggaggggttgggggtaggggtcggggtcgacggtcgggtcgtttaggggtaaccggtaaggacgaacgtacgtagtcgacccgtaaccgaagagtaggaagggcgaagacggtacgaacgtacgttaacccgacccggtaaccaacccccgaagaaccgacgaacgttcactacgtacgacaaccgtagaaccgacgtacgtaggaacgacggtccgaacgaccggtaacccgacgggacccgtttaaccgttaagtttacgttaggtacggcggttaaagtacgtttaggttttctacggttctaccgttagtacgttaatttcgaagtacgtaacgttacttcggtacggtcgttaacggttcgttcgggtacccgggg

SEQ ID NO: 340425 - DNA, 843 bp, Homo sapiens
  misc_feature: GZ8MTXP02IXSRP.17.10.A10.1.454.CMB.2.raw
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaagccgtggggcatcagtgactgtctcctgacaaggccagtaggatatatcttanaacaaaatgtggtatagaagttgggtacgcgaacgtaccgggacccccggaagaacgggtcgtttaagggcggggttgggggttacgggggtggggtaccgtacgggtccggggtacgtttttacgggaaacggggttaacggacctaaccgtaaggttacgtacggaccccgaaacccggggaaagacggttagggaaacggggtacgaacggtacgggtccaaacggtaaccgttacccgaacccggggaaacccccaaacccccggtaaacgaaacctacgggtaacgtaccttaaacagttacgaaacttaccgtaaggaccggaaacggtcccgtaagaaacggtacgttaccgggaacggaacccgtaaacccgccggggaacccgtttaacgttacgtttaacccgtggggttacgaaccggttaaagttaaaggtttttcttttttaaaacccggtagtttaaccgtaaacgtttaaacgttaaacgtttaacggtttacgtaaacggttacgttaaccgtttaacgttaacgggttcggttaaccggtttcggttaacggtttaccgggggtaacgggg

SEQ ID NO: 340426 - DNA, 687 bp, Homo sapiens
  misc_feature: GZ8MTXP02JG5DV.17.10.A10.1.454.CMB.2.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtgggcatcagtgactgtctcctgcaaggcagtgatntatcttanaacaaatntgtatgtaagttggngcacgacggccccggagaggctggaggtggggtaggggtggtacgagcggtgtttagggacggtaggcaagtagtagtcggacccacgaaagtacgtagggaagggtaccaaggtacggtactaacggtaacgttaacccgaaccgggaaccccaaacccccgaaacgaaaacctaacgtaacggttacctaaacgtacgttacgaactaaccgacgaaccgacgaccgtaggaaacgcgtacgacggaaccgacgtacccggggtacctacgttaacgttaccgtaggtacggtaccgtaagttaaacgttttcgtttaacgttcggttaactactttaccggtaaatttacgttaaccggtagtacgtcgttacgttaaggtcggtacttacggttacgttcgggtaaccgggg

SEQ ID NO: 340427 - DNA, 720 bp, Homo sapiens
  misc_feature: GZ8MTXP02FKJR8.17.10.A10.1.454.CMB.2.raw
  modified_base (277)..(277): a, c, t, g, unknown or other
  misc_feature (277)..(277): n is a, c, g, or t
  modified_base (589)..(589): a, c, t, g, unknown or other
  misc_feature (589)..(589): n is a, c, g, or t
  modified_base (597)..(597): a, c, t, g, unknown or other
  misc_feature (597)..(597): n is a, c, g, or t
tcagcgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtcgcccacgcccaggttcagttggtgcagacgtggggctggaggtgcagaagccgtggggcatcagtgactgtctctgcaaggccagtggatatatcttacaacaaaatatggtatagaattgggngcgacacggcccccgagaaggcgtgagggtgggtggggtggtcgaggcgggtcgtttaggaacggtaaggctaacgaggtacgtgacccgaaccggaaagagtacgggaaaggggccaagggtacgtaccgaaacggtaacgttaacccccgaaccggggtaaccccaaaacccccccgaacggaaaacctacccgaaacgttacccgtaaactacgtacgaacccgtaaaacccgttggaaacggaccgaccccgtaaggtaaggacgacgtacggaaccgaccggacccggtaccgttactagtttacgnggttacgnggtaaacgtacgtttcgttttacgtgtacctaaggtttaccgtaaaacttacggtttacaggtttaaccggaactttcggttaatacgggtacggtacggttaacgttcggggtaaccggggg

SEQ ID NO: 340428 - DNA, 673 bp, Homo sapiens
  misc_feature: GZ8MTXP02GR9PV.17.10.A10.1.454.CMB.2.raw
  modified_base (207)..(207): a, c, t, g, unknown or other
  misc_feature (207)..(207): n is a, c, g, or t
  modified_base (258)..(258): a, c, t, g, unknown or other
  misc_feature (258)..(258): n is a, c, g, or t
tcagcgtagactagcacgaccggtgctcgatttagcgtcgatctcaggggagctctgcttcagctgtgagcgcagaaggcaggactcgggacaatcttcatcatgacctgctccctctcctcctcacccttctcattcactgcacagggtcctgggcccagtctgtgttgacacacgccgccctcagtgtctcgccggcccccgganaggacggtcacatctctgctctacggaaacccccatcgtgatcaatatgtntctggtacagcactccggatcacgaccccctaaactcctcaactatactagaaagaattaaactaacgacaaccctcggtacgggtaccccgtacgaacccgtaattcctcgtcggaccttccgtaaacgttcgtcgggtaactacccgttcgtcgggaacccccttacccgtgggggaccttaaaccccgtacccgacccgtacccgtacccgtaccgtaaccggtacgggtaccggggtaccggacggtaccggtacgttacgttacgtacgtacgtacgtaacgtacgtacggtacgtaccgtacgtacgtacgtacgttcggttcgggttcggtcggtacggtacggtacggtaccgtacgtacgtacgtaaccgtaccgtacgtacgacgaccgtaccggtaccgtcccg

SEQ ID NO: 340429 - DNA, 597 bp, Homo sapiens
  misc_feature: GZ8MTXP02FZ49T.17.10.A10.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (384)..(384): a, c, t, g, unknown or other
  misc_feature (384)..(384): n is a, c, g, or t
  modified_base (453)..(453): a, c, t, g, unknown or other
  misc_feature (453)..(453): n is a, c, g, or t
  modified_base (555)..(555): a, c, t, g, unknown or other
  misc_feature (555)..(555): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagcctggggcatcagtgactgtctcctgcaaggccagtggatatatcttanaacaaaatatggtatgaattgggtgcgacacggcccccgganaagggcttgaggtggggtaggggtggtcgaggtcggtctttggacggttaaggcacgagtactcgaccaccggaagagtaggaagggacagngtacgacgtattacccgacggaccacccccgaagaacacagtcacatcgacactgacgtcgacctgagngaccgtggaccgacgaccggtaccttcgtaagttactggtacgtacgagtaacttgtttacctggtcctaagttaccgtaactagttttcgaagttacggtnttaccgtagtacgggtacgtaggtaccgttcggtaccggggg

SEQ ID NO: 340430 - DNA, 761 bp, Homo sapiens
  misc_feature: GZ8MTXP02HIC3A.17.10.A10.1.454.CMB.2.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaggccagtggatatatcttcaacaaaatatggtatgtaattggggtgacgacacgggcccccggaagaacggggcgttgagggtcggggtggggtcgggtcgaggtcggtcgtttaggaccgggttaaggccgtaagtacggtatacgacccgtacccgggaaagtacgtaggaagggggacaaggtacgggtaccacggggtaacttaacccggaccggggaacccaccccccgaaacggaaacctaacggaacgtaccttaaaccgactacgaccgtaaccgtacggaaccggtacgaccgttggaaacggcgggaaccgttacgaccgggaaaccgtacccggggtaaccccgtttaacgtacgttttacgtacggttacggtaaccgggtaagtaaaagtttcggtttttacgtcggtttctaaaccgtttaccggtaaactttaaaacgtttgtaaccgttaagggtaaccccttacggggttaataccgggtacgttaccggggttaactttaccgggtaccggggg

SEQ ID NO: 340431 - DNA, 664 bp, Homo sapiens
  misc_feature: GZ8MTXP02I79JC.17.10.A10.1.454.CMB.2.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (459)..(459): a, c, t, g, unknown or other
  misc_feature (459)..(459): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttcaanaaaatntggtatagtaagttgggtnacgagaccggcccccggtaanaaggggcttggagggtggggtggggtggtcaggcgggtcgtttaggacgggttaagccagtaggtatgccccgaacgaagacgtaggaacggggcacgggacgtcaacgtactacccgacggacccaacccccgtaagaaaccacgtacgtacgactangaccactacggaacgaggacctggaacgaacggctacggacgaaccggcggtacccgttacgtacgttaacgtggtaacgaccggaagttaacgttcggtttctcgttactacgttaacccggttaattaacgtttaggtaccgttaaggtcccgttaacgtacggttaggtaacttcggggtacctttaacggggttccggggg

SEQ ID NO: 340432 - DNA, 684 bp, Homo sapiens
  misc_feature: GZ8MTXP02FIYTE.17.10.A10.1.454.CMB.2.raw
  modified_base (265)..(265): a, c, t, g, unknown or other
  misc_feature (265)..(265): n is a, c, g, or t
  modified_base (326)..(326): a, c, t, g, unknown or other
  misc_feature (326)..(326): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccaccgcccaggttcagttggtgcgagacgtggggctggaggtgacgaggaagccgtggggcatcagtgactcgttctcgtcgacgacggcgaggtgattatatcttanaaataaaatgtgtagtgaagttgggtgacgaccgaccgggacccccggaaggaggtgttgnggggtggggtggggtggtcgaggtcgtgttaggacgtaggacacgtatgtgaccgaacgagagtaggaaggacgagaccgacaacgtaactaccgaaccgaacccaccccgaagacgacgtacgtacaacatacgacacggtagaccgtnacgtagacgtacgaggaccggacgaccgtaccgggtactaccgtttagtacggtaggtagtaaccggttaagtttacgttttcgggtttactacggtttcgaaacgtttacccgttaaagtttaacgtttaggaaaccgttcgttaaccggttagttaacggtaccggtttacggttaaccggttccggttaggggtaaccccggggg

SEQ ID NO: 340433 - DNA, 657 bp, Homo sapiens
  misc_feature: GZ8MTXP02F1G6X.17.10.A10.1.454.CMB.2.raw
  modified_base (216)..(216): a, c, t, g, unknown or other
  misc_feature (216)..(216): n is a, c, g, or t
  modified_base (500)..(500): a, c, t, g, unknown or other
  misc_feature (500)..(500): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtnactgtctcctgacaaggccaggtggtatagtattctttcaactaaaattataggtatgaaacgttgggtgacgacgtacggacccccggtagaacggtcttggaggtggggtaggggtggtcgaggtcggtcgtttcggacggtaaggcaacgtagtaatcgacgtaaccgaagatacggaaaggggcctaaggacggtacaaacggaaactttaacccgaaccggaaccgaaccccccaagaaacgaccacttacaacgatcgaacaaccgttagaaccgtanccgtagacgagcgtagacgacgaaccgggtcgtacttagttaccgtgtacgtacggagtaagtttcgtttacgcggttactacgttactaaacgtttagtttacgagtacgtaacctcgttaagtcggtaactcgggtaacctttcggaaccggggg

SEQ ID NO: 340434 - DNA, 514 bp, Homo sapiens
  misc_feature: GZ8MTXP01B4LLQ.10.37.D04.1.454.CMB.2.raw
  modified_base (499)..(499): a, c, t, g, unknown or other
  misc_feature (499)..(499): n is a, c, g, or t
  modified_base (504)..(514): a, c, t, g, unknown or other
  misc_feature (504)..(514): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctggaggacctttggagttttattactgtcagccagtatcataactggccctcggtggaccgttcggaccgaaaggggacccaaagggtcggaccctacgaaaaccgaacgtgtggctggccaccatctgtcttcacttccttccccgctatctgacctactactatgtctgacgcgggctgggcaaggccganattgnnnnnnnnnnn

SEQ ID NO: 340435 - DNA, 502 bp, Homo sapiens
  misc_feature: GZ8MTXP01EJ62P.10.37.D04.1.454.CMB.2.raw
  modified_base (406)..(406): a, c, t, g, unknown or other
  misc_feature (406)..(406): n is a, c, g, or t
  modified_base (492)..(502): a, c, t, g, unknown or other
  misc_feature (492)..(502): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggacgtcccagccaggttcaggcggcggtgggtctgggacagacttcactctcaccatcagcagcctgcagtctgaggtacctttggtagtttattactgtcagccagtatcaatactgcctcgtgacgttcggaccgtaagggacaagggtcgacctacgaaacgactgngctcgacacatctgtctcacttccttcccgctatcctacgactactactatcgtctggacgcgggctggccaagggcacgaattgnnnnnnnnnnn

SEQ ID NO: 340436 - DNA, 494 bp, Homo sapiens
  misc_feature: GZ8MTXP01BF0CK.10.37.D04.1.454.CMB.2.raw
  modified_base (307)..(307): a, c, t, g, unknown or other
  misc_feature (307)..(307): n is a, c, g, or t
  modified_base (484)..(494): a, c, t, g, unknown or other
  misc_feature (484)..(494): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtcngaggacctttggagtttatactgtcagccagtatcatactggccctcgtggacgttcggccaagggaccaggtcgactcaaacgactgtggctgcacagtctgtcttcacttccttcccgctactctgaacctctactatgcctgacggcggggtctcgggcaagggcgcaagttgnnnnnnnnnnn

SEQ ID NO: 340437 - DNA, 499 bp, Homo sapiens
  misc_feature: GZ8MTXP01A6FJ2.10.37.D04.1.454.CMB.2.raw
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (474)..(474): a, c, t, g, unknown or other
  misc_feature (474)..(474): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagccctcttccagggccactggagtcccagccaggttcagcggcggtgggtctgggaacagcttcgactctcaccatcagcagcctgcagtctgaggaccttggagttatactgtcaggcagtatcataacngactcgngtacgtcgcagggcaaggttggacttcgaaacgaacngttcggctgcaacatcagtcttctc

SEQ ID NO: 340438 - DNA, 493 bp, Homo sapiens
  misc_feature: GZ8MTXP01DI32Z.10.37.D04.1.454.CMB.2.raw
  modified_base (293)..(293): a, c, t, g, unknown or other
  misc_feature (293)..(293): n is a, c, g, or t
  modified_base (343)..(344): a, c, t, g, unknown or other
  misc_feature (343)..(344): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (484)..(493): a, c, t, g, unknown or other
  misc_feature (484)..(493): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggacgtcccagccaggttcaggcggcggtgggtctggggacagacttcactctcaccntcagcagcctgcagtctgaggacctttggatttatactgtcagccagtannaatactggcctcggtgacgttcggacaaggtacagggtcgacctanaaacgactgngctagcacatctcgtcttcactcgttccccgctatctgactactactatgctgacggtcgggctggcgaaggcgacgagttagnnnnnnnnnn

SEQ ID NO: 340439 - DNA, 878 bp, Homo sapiens
  misc_feature: GZ8MTXP01CS6B8.10.37.D04.1.454.CMB.2.raw
tcagcatagtagtgcacgaccggtgctcgatttagtagcatactgttgggtttgggggaggaactgctcagttaggacccagacggaaccatggaagccccagcgcagcttctcttcctcctgctactctggctccagattccactggagaaattagttttgacgcaatctccagccaccctgtctgtgactccaggtgagagacgccaccctctctgcgagggccagtcgaggggatcgagcagactaatttacgcctaggtaaccaacgagaacgccgtggacctacggttcccagtacctcctactaattaatagtacgaaccgtccccttaccgttaccgacggggcccctaacggttcgggaaccgttacccccgaaggtccccgtaaggggtttccgaaccggggtccgggggtcgggggttcgggggttacccggtacggggggaaaaccctaacgggttaaccccgtttacccgtaaacccgtttaccctaccccgaaaccctaacgttacccggaaaccggtcccgtaaccggtccccgttacggacccgttaacgggttcccgttaacgggggttaaccggggtttaacccgttttaggggggtttaaacttttttaaacgtttaaccggttcggttaaccgaagggttacccgttaaaggtttaaccttacgtaaacgttaaccggtccgggttaccccgtttaccggggtaccgggttaacccgggtttacccggggaaacccggtaaacgggggtaacccgtaaacggggttacccgggtaaacccttaacggtaaaaaccggtacgttcggttcggttacctcggaccctaacctagttccgttcgtttcccttccgtaacccg

SEQ ID NO: 340440 - DNA, 589 bp, Homo sapiens
  misc_feature: GZ8MTXP01AG3IG.10.37.D04.1.454.CMB.2.raw
  modified_base (276)..(276): a, c, t, g, unknown or other
  misc_feature (276)..(276): n is a, c, g, or t
tcagcatagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagacgccaccctctcttgcgagggccagtcgaggggatcagcagcaattagcctggtaccaanagaagcctggccaggttccccagacctcctcatatatgaacgcctctccgagggccacgtggaccgtcccagcccgaggttcaaggcgggcggtgggtcgtgggacagtactcactctcacatcagcagcctgcagtcgtaggacggtaccttggggtaactttattacgtgtctagctaagttactactaattaaccgtcggtcccgttcggtacggttaccggttccgggaccgtaaacggggacccgttaaggggttcggaaccccgtaacgaaaccggtaacgtagggtcggacgtcgaaccgtaaccg

SEQ ID NO: 340441 - DNA, 546 bp, Homo sapiens
  misc_feature: GZ8MTXP01EQXDT.10.37.D04.1.454.CMB.2.raw
  modified_base (218)..(218): a, c, t, g, unknown or other
  misc_feature (218)..(218): n is a, c, g, or t
  modified_base (516)..(516): a, c, t, g, unknown or other
  misc_feature (516)..(516): n is a, c, g, or t
  modified_base (532)..(532): a, c, t, g, unknown or other
  misc_feature (532)..(532): n is a, c, g, or t
  modified_base (540)..(540): a, c, t, g, unknown or other
  misc_feature (540)..(540): n is a, c, g, or t
  modified_base (542)..(546): a, c, t, g, unknown or other
  misc_feature (542)..(546): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaanccttcttccgagggccacgtggacgtcccagccaggttcaggcggcggtgggtctgggacagacttcactcttaccatcagcagcctgcagtctagacggtacctttgggtattttattactgtcagcagtatacaataactcggacccttccggtgggtaccgttccgggacccgaaaggggacccgtaaggggtcgggaccctacgaaaacgaactgggtcgctggaccacctatctagtcttctactcccttcccggctatctagacctactactagtcgctggacggtcggggntaacgggcaaggggcncgataggngnnnnn

SEQ ID NO: 340442 - DNA, 744 bp, Homo sapiens
  misc_feature: GZ8MTXP01B8DLK.10.37.D04.1.454.CMB.2.raw
  modified_base (264)..(264): a, c, t, g, unknown or other
  misc_feature (264)..(264): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcgaggggatcagcagctaatttagcctggtaccaanagaagcctggccaggtcccagacctcctacatatatgaagccctccttccgagggcccacgtcgggacgtccccagccgaggttccgacggccggggcgggtggggtccgtagggggaaaccaggtaacctttccgaaccttcctaccaacctatccgaacggccaacggccccttaggcctaaggttccgtaggaaccgggttaacctttggggtaaacgtttttaattaaccgttggttaccgaaaggggtccgttaaaggtttactacccgtaaagtttaaacccgttccggggtaccccgttttacccggggtggggtaaaccccgggttttccgggaaccccgggtaaaacgggggaaccccgtaaaggggttcgggtaaacccccttaacggaaaaaccggtacccgttgggttcggaccgttcggacccctaaccccgtagttcccgttacggttaaccctttcgtaaccccg

SEQ ID NO: 340443 - DNA, 725 bp, Homo sapiens
  misc_feature: GZ8MTXP01B3MWE.10.37.D04.1.454.CMB.2.raw
tcagcatagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggaagaaatagttttgacgcaatctccagccaccctgtctgtgactccaggtgagagacgccacctctcttgcagggccagtcgaggggatcagcagctaattacgcctaggaaccaagagaacgcctcggccacggttccccagacctcctacatatatcgaacgtcccttcgtaccgacgggccacgtcggaccgtcccaggccgtacggtcgaacggcgggtcgggttgggtccgtagggaaccacggttaccttcgaacccttcaccgaacctagtccgacgaccgtaacggtcccttacggcctacggttcccgtaagggtaacggtttacccggtttagggggttaaacgtttttaacgttaccgtacgttacgtaagtacgtaacggttactacgtaaacgttaaccgtccgggtacccgtttaaccggggtacgggttacccgttacggggaacccggtaaaagggggtaacccgttaaagggggttccggttaaacccgttaacggtaaaagttaaccggtaacggtacgggttcggttaaccgttccgtaaacccg

SEQ ID NO: 340444 - DNA, 596 bp, Homo sapiens
  misc_feature: GZ8MTXP01ASFW6.10.37.D04.1.454.CMB.2.raw
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(596): a, c, t, g, unknown or other
  misc_feature (586)..(596): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagccttcttccagggccacgtggactcccagccaggttcaggcggcggtgggtctgggacagacttcactcttaccatcagcagccctgcagtctaggacggtacctttgggtagttttattactggttacaggctaaggtactcaagtaacgtcggacccttcggtgggaccgtttcgggaccgaaaggggaccctaaaggggtcgaacccttacgaaacgtaacgttcggacgggcctaggcctaaccctattctcggttcctttcaactttccccggttccccgcttaacgttcccacgtaacctaccttactactcggtaccgtgggacggcggggtctcggggacaagggggccngtaagngngnnnnnnnnnnn

SEQ ID NO: 340445 - DNA, 723 bp, Homo sapiens
  misc_feature: GZ8MTXP01BWOV1.10.37.D04.1.454.CMB.2.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagcccaccctgtctgtgactccagggtggagacgccaccctctcttgcgagggccagtcgaggggatcagcagctaatttacgcctaggtaacccaacgagaacgccgtacggccctacggttccccaagtaccttccctacaattataagtagaacgtcccttccgttacccgaaggggcccctacgtcgggaaccgtccccgagtccccgtaggttcgacgggtcccggggcgggttggggtcgtggggacctaaacgtaccttcacctccgtaccaacctagtccgacgccacgtccctaggcctagttccgtagggtaacgggttaccgtttagggtacttttaagttaccgttgtacgtaacgtcgtaagttaactacgtaaacgttaaccggtcgtacccgttccggtacgggtacccggttccgggaacccgtaaaggggacccgtaaaggggttcgaacccgttaacgaaacggtaacgttggttacggcgttcgaaccgtacctaacgttccgtacgttaccgttaaccgaactttccccg

SEQ ID NO: 340446 - DNA, 565 bp, Homo sapiens
  misc_feature: GZ8MTXP01CGRKD.10.37.D04.1.454.CMB.2.raw
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggtcccagactcctcatatatgaacgcctcttccagggccacgtggacgtcccagccaggttcacggcggnggtgggtcngggaacngtctcactcncaccatcagcagcctgcagtctggacgtaccttggagtttatacgtgtcagggctaaggtatacattaacgtcggtaccctccggtaggtaccggttcggaccgaacggggtaaccgaagggttcggaccttacggaaaccgtacgttggttcgggctggacctaaccgattccgttacgttccttctaaccg

SEQ ID NO: 340447 - DNA, 478 bp, Homo sapiens
  misc_feature: GZ8MTXP02G0MFO.10.37.D04.1.454.CMB.2.raw
  modified_base (384)..(384): a, c, t, g, unknown or other
  misc_feature (384)..(384): n is a, c, g, or t
  modified_base (470)..(478): a, c, t, g, unknown or other
  misc_feature (470)..(478): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttatactgtcagccagtatcataactggcctcgtgacgttcggccagggaccaggtggacctnaaacgactgtggctgcaccatctgtcttcattcttaccccgcacttctgacactactatgctgagcgggctggcaaggcgcatagnnnnnnnnn

SEQ ID NO: 340448 - DNA, 492 bp, Homo sapiens
  misc_feature: GZ8MTXP02F3HWR.10.37.D04.1.454.CMB.2.raw
  modified_base (437)..(437): a, c, t, g, unknown or other
  misc_feature (437)..(437): n is a, c, g, or t
  modified_base (486)..(492): a, c, t, g, unknown or other
  misc_feature (486)..(492): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggacccttggagttttatactgtcagccagtatcataactggcctcggtgacgttcgaccaaggtaccaggtcgacctcaaaacgactgtgctgccacatctgtcttcattccttcccgcattcgtanaacctactactatcgctgacgcgggctgggaccaaaggccgacagtagnnnnnnn

SEQ ID NO: 340449 - DNA, 549 bp, Homo sapiens
  misc_feature: GZ8MTXP02JY23Q.10.37.D04.1.454.CMB.2.raw
tcagcatagtagtgcacgaccggtgctcgatttagtagcatactgttgggtttggggaggaactgctcagttaggacccagacggaaccatggaagccccagcgcagcttctcttcctcctgctactctggctcccagattccactggagaaatagttttgacgcaatctccagccaccctgtctgtgactccaggtgagagagcccaccctctcttgcagggccagtcaggggatcagcagcaatttagcctggtaccaacagaagcctggccaggttcccagacctcctcatatatgaagcctcttccgagggcccacgtggacgtcccagccaggtcaggcggcggtgggtctgggacagctcactctcaccatcagcagcctgcagtctgacggtaccgttggacgtttattacgtgtcagctagtatactataactggcctccggtcggtaccgttcgggaccgaaacggggtaccgaaaggggtcggacccgtacgaaaacggacgtacggtacggacctgaccaccgatctcgtcttactac

SEQ ID NO: 340450 - DNA, 516 bp, Homo sapiens
  misc_feature: GZ8MTXP02JWD13.10.37.D04.1.454.CMB.2.raw
  modified_base (396)..(396): a, c, t, g, unknown or other
  misc_feature (396)..(396): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagacctcctcatatatgaagcctcttccagggccactggactcccagccaggttcacggcgggcggtgggtcgtgggacaggccttcactctcaccatcagcagcctgcagtcngacggtaccttgggtatttatactggtcagcagtatcataactggcctcggtggacgttcggacgaagggaccaagggtcgacctacgaaacgactgtacgctgcacatcgcgtctctac

SEQ ID NO: 340451 - DNA, 533 bp, Homo sapiens
  misc_feature: GZ8MTXP02HIQ1N.10.37.D04.1.454.CMB.2.raw
tcagcatagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaattagcctggtaccaacagaagcctggccaggttcccagacctcctcatatatgaagcctcttccagggccactggaccgtccccagcccaggttcaggcggcgggtgggtctggggacagacttcactctcaccatcagcagcctgcagtctgaggtaccttggagttttatactgtcagctagtatcataacgtgcctcggtggtaccggttcggaccgaaacggggaccgaagggtcggacctaacgaaacgaacgtgtacggctcggacaccg

SEQ ID NO: 340452 - DNA, 506 bp, Homo sapiens
  misc_feature: GZ8MTXP02JTRWD.10.37.D04.1.454.CMB.2.raw
  modified_base (495)..(497): a, c, t, g, unknown or other
  misc_feature (495)..(497): n is a, c, g, or t
  modified_base (499)..(506): a, c, t, g, unknown or other
  misc_feature (499)..(506): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggacgtcccagccaggttcagcggcggtgggtctgggacagacttcactctcaccatcagcagcctgcagtctggacggtaccttggaattttatactgtcagccagtatcatactggcctcgtggacgttcggacaagggaccaagggtcgacctcgaaacgactgaggctgccacatctgtcttacattccttcccgcatctagaactcttaactagtcgctagacgcgggtactgggacaacgggccgaacacgtgnnngnnnnnnnn

SEQ ID NO: 340453 - DNA, 550 bp, Homo sapiens
  misc_feature: GZ8MTXP02H0TML.10.37.D04.1.454.CMB.2.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagacctcctcatatatgaagccctcttccgagggcccacgtggacgtccccagccaggttcaggcggcggtgggtctggggacagtcttcactcctcaccatcagcagcctgcagtctgacggtaccttgggacgtttatactgtcagtcagtatactagtaactggtacccttcggtcggtaccgttcgggaccgtaaacgggaccgaagggttcggaacctacgaaacgtaacgtgtcggctaacgcacactctcgttccttctac

SEQ ID NO: 340454 - DNA, 603 bp, Homo sapiens
  misc_feature: GZ8MTXP02I4D8O.10.37.D04.1.454.CMB.2.raw
  modified_base (402)..(402): a, c, t, g, unknown or other
  misc_feature (402)..(402): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcgaggggatcagcagcaatttagcctggtaccaacagaagcctggccaggttcccagacctcctcatatatgaacgtccctcttccgaggggcccacgtggactcccagcctaggttcacggcggcggtgggtctggggacagtctcactctcaccatcagcagcctgcagtcngacggtaccttggtagtttatactgtcagtctagtactactaataacgtcggcccttcggtacgggtaccgtttcgggaccgaaaggggaaccccgtaaggggttaccggaacccgttaaaccgaaaaccggtaacgtttacgggcgggtacctaacgggtacccaaacctacggttacgttccgttcctttacgtacccg

SEQ ID NO: 340455 - DNA, 513 bp, Homo sapiens
  misc_feature: GZ8MTXP02HF3CZ.10.37.D04.1.454.CMB.2.raw
  modified_base (407)..(407): a, c, t, g, unknown or other
  misc_feature (407)..(407): n is a, c, g, or t
tcagcatagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaattagcctggtaccaacagaagcctggccaggtcccagacctcctcatatatgaacgcctcttccagggccactggacgtcccagccaggttcaggcgggcggtgggtctggggacagacttcgactctcaccatcagcagcctgcagtcngacggcttggacgtttatacgtgtcagcagtatcatacgtgcctcggtggacgttcggaccgaacgggaccaggtcgaccaacgaaacgacgtgacgcacgccacg

SEQ ID NO: 340456 - DNA, 486 bp, Homo sapiens
  misc_feature: GZ8MTXP02GG6NN.10.37.D04.1.454.CMB.2.raw
  modified_base (338)..(338): a, c, t, g, unknown or other
  misc_feature (338)..(338): n is a, c, g, or t
  modified_base (387)..(387): a, c, t, g, unknown or other
  misc_feature (387)..(387): n is a, c, g, or t
  modified_base (476)..(486): a, c, t, g, unknown or other
  misc_feature (476)..(486): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggatcccagccaggttcagcggcggtgggtctgggacagacttcactctcaccatcagcagcctgcagtctgaggaccttggagtttatactgtcagccagtntcatactggcctcgtggacgttcggaccaagggaccaagggtgacctanaaacgactgtaggctgcaccatctgtcttcatccttcccgctatctgaccatactatgctgacgcgggtctggccaaaggcgacatagnnnnnnnnnnn

SEQ ID NO: 340457 - DNA, 549 bp, Homo sapiens
  misc_feature: GZ8MTXP02GC35A.10.37.D04.1.454.CMB.2.raw
  modified_base (382)..(382): a, c, t, g, unknown or other
  misc_feature (382)..(382): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagacctcctcatatatgaacgcctcttccgagggccacgtggactcccagccaggttcacggcggcggtgggtctggggacaggcttcgactctccaccntcagcagcctgcagtctagacgtacttggatttatactgtacagcagtatacaataacgtcggtaccctcggtacggtaccggttccggaccgtaaacggggtaccaaggggttcgaccgtaacgaaacgtacgtcgtacggctggaccactactctcgtctactac

SEQ ID NO: 340458 - DNA, 493 bp, Homo sapiens
  misc_feature: GZ8MTXP02IW3UM.10.37.D04.1.454.CMB.2.raw
  modified_base (483)..(493): a, c, t, g, unknown or other
  misc_feature (483)..(493): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggacctttggagtttatactgtcagccagtatcataactggcctcgtgacgttcggaccaagggaccaagggtcgacctacaaacgaactgtggctgcacatctgtcttcattcctcccgcactctagaccactactatgacctgacgcgggtctgggacaacggcgcagtagnnnnnnnnnnn

SEQ ID NO: 340459 - DNA, 556 bp, Homo sapiens
  misc_feature: GZ8MTXP02JPAAP.10.37.D04.1.454.CMB.2.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (549)..(556): a, c, t, g, unknown or other
  misc_feature (549)..(556): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagacctcctcatatatgaagcctcttccgagggccacgtggactcccagccaggttcaggcggcggtgggtctgggacagactcactcttacatcagcagcctgcagtctgaggtacctttgggtattttatactgtcagnagtanactatacgtggccctcggtcggtacgttcggaccaaggggaccaagggtcgacctacgaaacgtactgtacggctacgactaccattctagttccttactacttcccttcccgacctattcgtacgaacctacttactacgttgccgttagggacgggtcggtcgtcggggaacgaacggggcccgtagaaagtcgngngnngnnnnnnnn

SEQ ID NO: 340460 - DNA, 577 bp, Homo sapiens
  misc_feature: GZ8MTXP02GF8ZA.10.37.D04.1.454.CMB.2.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagacctcctcatatatgaacgcctcttccgagggccacgtggacgtcccagccaggttcacgcggcggtgggtctgggacagctcgactctcaccatcagcagcctgcagtctagacggtacctttggtagtttattacgtgttccaggtctaagtactactaattaaaccgtcggaccttccggtaggaccgtttccgggaccgaaacggggaccgaaacgggtcggaaccctacgaaaaccgtacgtacggtacggacgtcgtaccgaccgtacgtctacgtccttctaaccg

SEQ ID NO: 340461 - DNA, 722 bp, Homo sapiens
  misc_feature: GZ8MTXP02IKXM3.10.37.D04.1.454.CMB.2.raw
  modified_base (697)..(697): a, c, t, g, unknown or other
  misc_feature (697)..(697): n is a, c, g, or t
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
  modified_base (720)..(721): a, c, t, g, unknown or other
  misc_feature (720)..(721): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccgaggccactggatcccagccaggttcagcggcggtggtctgggacagaccttcactctcacatcagcagcctgcagtctagaggtacctttggtatttatacgtgtacagtccctaagtactacaacttaacgtcggtaccccttccgggggttacggtaacccgggtttacccgggggaacccgtaaaacggggggaacccgtaaaagggggtttaccggaaaccccgttaaacgaaaaacccggttaaccgttggggtacgggtacccttacggaacccgtaaccgttaagttccttcgttaccttttaccgtaaccctttcccgtttcccccggaccttaacgtttccctaaacggaacccttaaaccttaaacgtttactaccgggtaccgttaggggtaaccggggcccggggtacgttacgggggacccgtaaaacgggggtccccgtaaacgtaaacggtacgngacgaacgacgacgacgngcncnng

SEQ ID NO: 340462 - DNA, 530 bp, Homo sapiens
  misc_feature: GZ8MTXP02INHHF.10.37.D04.1.454.CMB.2.raw
  modified_base (520)..(530): a, c, t, g, unknown or other
  misc_feature (520)..(530): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcaggcggcggtgggtcgtgggacagacttcactctcaccatcagcagcctgcagtctgagtaccttggatttattactgtcagcctagtatcatactggccctcgtggacgttcggacctaaggggacaaagggtcgaacctacgaaacgtaactggtcgctagccaaccattccgtgttccttactacttcctttccccgcctagttcctagacctactacttatcgcgttgacggcgggtactcgggcaacgggcacgtagtacgnnnnnnnnnnn

SEQ ID NO: 340463 - DNA, 517 bp, Homo sapiens
  misc_feature: GZ8MTXP02IR4ME.10.37.D04.1.454.CMB.2.raw
  modified_base (507)..(517): a, c, t, g, unknown or other
  misc_feature (507)..(517): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggatccccagccaggttcagcggcggtgggtatgggacagacttcactctcaccatcagcagcctgcagtctgaggtacccttggtagtttattactgtcagccagtatcatactggccctcggtgacgttcggacctaaggggacaaggggtcgacctacaaacgactgtaggctagccacatctgtcttcacgttccttcccgtcctactctacgacctactactatacgtcgtagacgcgggtcgtggacgacgggtacgactacgagnnnnnnnnnnn

SEQ ID NO: 340464 - DNA, 500 bp, Homo sapiens
  misc_feature: GZ8MTXP02JVQIB.10.37.D04.1.454.CMB.2.raw
  modified_base (347)..(347): a, c, t, g, unknown or other
  misc_feature (347)..(347): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (491)..(500): a, c, t, g, unknown or other
  misc_feature (491)..(500): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccacgtggacgtcccagccaggttcaggcggcggtgggtctggggacagacttcactctcaccatcagcagcctgcagtctggacggtaccttggattttatactgtcagccagtancatactgcctcgtggacgtcggcgaaggccaaggtcgacctacgaaacgatgngcngccacatctgtctcacttccgtcccnctatctagaccacgtactagtcgactagggacgtcgggactgggacgaacgggcacgatagnnnnnnnnnn

SEQ ID NO: 340465 - DNA, 653 bp, Homo sapiens
  misc_feature: GZ8MTXP02IYE47.10.37.D04.1.454.CMB.2.raw
  modified_base (644)..(653): a, c, t, g, unknown or other
  misc_feature (644)..(653): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccgagggcccagtggactcccagccaggtcaggcggcggtgggtctgggacagacttcactctcaccatcagcagcctgctagtctggacggtacctttgggtaatttttactacgttgtacagtcctaagttactactaaattaacggtcggtcccttccggggttacgggtaacccgggtttcccgggaacccgaaacgggggtaccccgtaaaagggggttcccgggaaacccgttaacgaaaaccggtaaccgtcgggtcggaccgttacggacccaaacctacgtttccgttcgttacctttacccgtacctttcccgttacccccgtacctacttccgtaccaaccctaccttaaccttagtcgtacgtacggacggccggggtctacggggacaaacgggccgactacgacgnnnnnnnnnn

SEQ ID NO: 340466 - DNA, 590 bp, Homo sapiens
  misc_feature: GZ8MTXP02GM26B.10.37.D04.1.454.CMB.2.raw
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccgaggccactggacgtccccagccaggttcaggcggcggtggggtctgggacagacttcactctcaccatcagcagcctgcagtctgacggacctttggagttttatactgtcagccagtatcaataactggcctcggtgacggttcgccgaagggacctaagggtcgaccgtacgaaaacgacgtagtggtctacggcctaaccagttacctcggtcctttactacttacccgtttcccccgcctaacttccgtacgtaacctaccttaactaccgttagtccgttagggacggtccggggtacgttcggggaacgaaaccggggtcgaaccggttaagaacggtcgacgcgcgacnngncnng

SEQ ID NO: 340467 - DNA, 632 bp, Homo sapiens
  misc_feature: GZ8MTXP02GQCVW.10.37.D04.1.454.CMB.2.raw
  modified_base (282)..(282): a, c, t, g, unknown or other
  misc_feature (282)..(282): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagcatagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaattagttttgacgcaatctccagccaccctgtctgtgactccaggtgagagagccaccctctcttgcgagggccagtcgaggggatcgagcagcaatttacgcctaggtaaccaaanagaacgccgtaggccctacggttccccagacctcctacaatatatgaacgtcccttcttccgaggggcccacgtcggacccgtcccagccgtaggtcaggcgggcggggtgggtcgtggggacngtacttcactctcaccntcagcacgcctgctagtcgtaggacggtaccgttaggtacgttttatacgttggtacagtcgtaagtactactaacgttaccgtcggtcccttccgggtacggtaccgggttaccgggaaccggtaaacggggtaacccgtaaacggggtaccggtaaccgtaacggtaaaaccggtaacgttcggtacggccgttacggacctaaccg

SEQ ID NO: 340468 - DNA, 624 bp, Homo sapiens
  misc_feature: GZ8MTXP02IEFM5.10.37.D04.1.454.CMB.2.raw
  modified_base (404)..(404): a, c, t, g, unknown or other
  misc_feature (404)..(404): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcgagggccagtcgaggggatcagcagcaaatttgcctaggtaccaacgagaagcctgggacccaggttcccagacctcctcatagtatgaacgtcctactccgacggccacgtggacgtcccaagccgtaggtcacggcgggtcgggtggtcgtaggggactagtccgttcactcctacacctacncgacgcacgtccgtagcgtacggtcgtacgggtaccggttacgtttaggttaacgttttacgttacgttacgtacgtacggtacgttagttaactacgtaacttacgtcggtcccgttcggtacggtaccggttaccgggacgaaacgggacgtaagggtaccgaacctaaacggaaacgtcgtcgtcgacgcgaccacgtacttcgtcgttactactcg

SEQ ID NO: 340469 - DNA, 497 bp, Homo sapiens
  misc_feature: GZ8MTXP02F86U3.10.37.D04.1.454.CMB.2.raw
  modified_base (423)..(423): a, c, t, g, unknown or other
  misc_feature (423)..(423): n is a, c, g, or t
  modified_base (486)..(488): a, c, t, g, unknown or other
  misc_feature (486)..(488): n is a, c, g, or t
  modified_base (490)..(497): a, c, t, g, unknown or other
  misc_feature (490)..(497): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttatactgtcagcagtatcataactggcctccgtggacgttcggcccaagggtccaaaggtcggacctcaaaacgactgtggctgccaccattcctgtcttnatcttcccgcctatcctgaccactatactggctgaggtcgggctgggccaaacggcgcaatgnnngnnnnnnnn

SEQ ID NO: 340470 - DNA, 716 bp, Homo sapiens
  misc_feature: GZ8MTXP02GFJAR.10.37.D04.1.454.CMB.2.raw
  modified_base (713)..(713): a, c, t, g, unknown or other
  misc_feature (713)..(713): n is a, c, g, or t
  modified_base (715)..(716): a, c, t, g, unknown or other
  misc_feature (715)..(716): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccactggacgtcccagccaggttcaggcggcggtgggtctgggacagcttcactctcacatcagcagcctgcagtctaggaggtaccttggtagtttatacgtgtcagcctagtactacaataacgtcggacccttcgggtcgggtaaccggtttccggggaacccgtaacgggggaacccgtaaaggggtaccgggtaaacccctaaccggtaaaaaccggaaaccgttcgggtacgggtacccgttacgggacccctaaccggtaacgtttaccttacggtttcccttttaccgtaacctttccctttaccccggttccgtacccccttaattccccggttaaccgtaaaccccttaaactttaacctaacgttcggtaacccggttggggaacccggggtaccgggggtcgttacgggggaccggaaaaccgggggtccggtaacccgtaaaaggtaggaccgtcgacgacgacacgacncnn

SEQ ID NO: 340471 - DNA, 735 bp, Homo sapiens
  misc_feature: GZ8MTXP02GWOPG.10.37.D04.1.454.CMB.2.raw
  modified_base (267)..(267): a, c, t, g, unknown or other
  misc_feature (267)..(267): n is a, c, g, or t
tcagcatagtagtgcacgaccggtgctcgatttagtagcatactgttgggtttgggggaggaactgctcagttaggacccagacggaaccatggaagcccccagcgcagcttctcttcctcctgctactctggctcccagattccactggagaaatagttttgacgcaatctccagccaccctgtctgtgactccaggtgagagacgccaccctctcttgcagggccagtcgaggggatcagcagctaattagcctaggtacccaanagaacgcctggacccacggttcccacgtacctcctcatatatgaacgccttctccgagggccacgtggactccccagccgaggttcacggcgggtcggtcgggtcgtggggaacagtccttccgcttcctacgaccctaatccgaacgccgacgtcccgtgacccgagttccgtacgggtacgggttacccgttttaagggggttaactttttaacgttaccgtttacggttacgtaaacggtaccgttaagttaacttaccgtaaaacgtttaaaccggtccgggttaaccccgtttccggggttaacgggttaacccggggtttaccggaacccccggggttaaaagggggaacccggttaaaacgggggtaccgggtaaacccccgttaacgaaaaaccggtacggttacggtaaccggtcgtaacggaccctaacgtacgttcgtacgtttccgttactacccg

SEQ ID NO: 340472 - DNA, 623 bp, Homo sapiens
  misc_feature: GZ8MTXP02IKM4B.10.37.D04.1.454.CMB.2.raw
  modified_base (269)..(269): a, c, t, g, unknown or other
  misc_feature (269)..(269): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagacgccaccctctcttgcagggccagtcgaggggatcagcagctaatttacgcctaggtacccaaanagaacgcctggccaggttcccagacctcctacatatatgaactccctctccgagggcccacgtggacgtcccgagcctaggttcacggcgggtcggtgggtcgtaggggaccagtacgttcaactcctacccacctntaccagcagcctgacngtctgacggtacttggtatttatacgtgtacagctagttatactaataacgtcggtaccttcgggtacggtacgttaccggaacgtaaacgggtaccgtaaggggttaccggacccgttaaacgaaaaccggtaccgttacggggtacgacgtaaccgaccgtaaccgttacgttccgtttacgttaccgtttactacccg

SEQ ID NO: 340473 - DNA, 624 bp, Homo sapiens
  misc_feature: GZ8MTXP02IKK73.10.37.D04.1.454.CMB.2.raw
  modified_base (293)..(293): a, c, t, g, unknown or other
  misc_feature (293)..(293): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgatgcaatctccagccaccctgtctgtgactccaggtgagagagccacctctcttgcagggccagtcgaggggatcagcagctaatttagcctggtaccaacagaagcctggccaggttcccagacctcctnatataatcgaaacgcccttcttccgacggggcccacgtggactcccagccgaggttcccgagcgggcgggtgggtcgtcggggacagtaccttcactcctaccaacatacagcacggctgacagtcnggacgtacttgggactttatacgtgtacagtcaagttactanaacgtaacgtcggtacccgtcggtacgggtaccggttacggaccggtaaaacgggggacccgtaaagggtacgggtaaaaccccttacgaaaaacccggtaaacgtttcgggtaccggaacttcggaaacctacccgaattccgtttacgtcttttaacccg

SEQ ID NO: 340474 - DNA, 564 bp, Homo sapiens
  misc_feature: GZ8MTXP02JJAZO.10.37.D04.1.454.CMB.2.raw
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
  modified_base (408)..(408): a, c, t, g, unknown or other
  misc_feature (408)..(408): n is a, c, g, or t
  modified_base (554)..(554): a, c, t, g, unknown or other
  misc_feature (554)..(554): n is a, c, g, or t
  modified_base (562)..(562): a, c, t, g, unknown or other
  misc_feature (562)..(562): n is a, c, g, or t
tcagcatagtagtgcacgaccggtgctcgatttagtagcatactggttgggtttggggaggaactgctcagttaggacccagacggaaccatggaagcccagcgcagcttctcttcctcctgctactctggctcccagggccagtcaggggatcagcagcaatttagcctggtaccaacagaagcctggccaggttcccagactcctcatatatgaacgcctcttccgagggccacgtggacgtcccagccgtaggttcaggcggcggtgggtctgggacagacttcactcttaccntcagcagcctgcagtctgaggtaccttggtatttatactgtcagtcagtatcatacnggccttcgtggacttcggaccgaaggccgtaaggtcgaactacgaaacgactgnggctgacaccgatcgtagtctcactccttccgctatcctagactaaccctatactcgtcgtaggtaccggacggggtccttacgggggacccaaacgggggttccccacgggttaaacgtacgacgtacgcgaacgacgacgcacncacgtacncg

SEQ ID NO: 340475 - DNA, 552 bp, Homo sapiens
  misc_feature: GZ8MTXP02FI5TX.10.37.D04.1.454.CMB.2.raw
  modified_base (261)..(261): a, c, t, g, unknown or other
  misc_feature (261)..(261): n is a, c, g, or t
  modified_base (379)..(379): a, c, t, g, unknown or other
  misc_feature (379)..(379): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccacctctcttgcagggccagtcaggggatcagcagcaatttagcctggtaccaanagaagctggccaggttcccagactctcatatatagaacgcctcttaccagggccacgtggagtcccagccaggttcacgcggcggtgggtctggggacaggctcactctcaccatcancagcctagcagtctagacgaccttggtagtttatctaggtcaggctagtactataataactcggaccttcggtcgggaaccgttcgggaccgaaaaggggacccgaagggtacggaaccctacgaaaaccgaaacgtcggtaggaccgtgcaacccgatctacgtccttctac

SEQ ID NO: 340476 - DNA, 556 bp, Homo sapiens
  misc_feature: GZ8MTXP02JBW3G.10.37.D04.1.454.CMB.2.raw
  modified_base (355)..(355): a, c, t, g, unknown or other
  misc_feature (355)..(355): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(556): a, c, t, g, unknown or other
  misc_feature (552)..(556): n is a, c, g, or t
tcagcatagtagtgcacgaccggtgctcgatttagtagcatactgttgggtttggggaggaactgctcagttaggacccagacggaaccatggaagccccagcgcagcttctcttcctcctgctactctggctcccagggccagtcaggggatcagcagcaatttagcctggtaccaacagaagcctggccaggttcccagactcctcatatatgaagcctcttccagggccacgtggacgtcccagccaggttcaggcggcggtgggtctgggacagtacttcactctcaccatcagcagcctgcagtctagacggtaccttggatttattactgtacagtccagtatcatacnggcctcggtagacgttcggaccaaggggaccaagggtcgaacctcgaaaacgacgtggtacgctagccaactatctagttcttcgacttccttaccccgctacttctacgacctaacttactacgttcgaccgtttagaccggggccgggtacgttcgggaccgtaaaggggcaccgtaagtaccgngnngnacncnnnnn

SEQ ID NO: 340477 - DNA, 370 bp, Homo sapiens
  misc_feature: GZ8MTXP01BKX08.3.31.C09.1.454.CMB.2.raw
  modified_base (367)..(370): a, c, t, g, unknown or other
  misc_feature (367)..(370): n is a, c, g, or t
tcagagacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaaggcccatcggtcttcccctggccgccctgctccaggagcacctccgagagcacagcggccctgggctgcctggtcaaggactacttccgagtgcgtctctgagcgggcctggcaaggcgcaatagnnnn

SEQ ID NO: 340478 - DNA, 606 bp, Homo sapiens
  misc_feature: GZ8MTXP01DSZHJ.3.31.C09.1.454.CMB.2.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (411)..(411): a, c, t, g, unknown or other
  misc_feature (411)..(411): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcaactacttagcctggtaccaaanagaaacctggccaggctcccaggctcctcatctatgatgcatccaacagggccactggcatcccagccaggttcagtcggcaggtgggtctggggaacagcttcactctcaccatcgagcacgcctaagcgtacctagaaagtttnttttcgacttaagtttattacgttgtaccgaggtacgtaaggtacgtaacgacctaacgtcggtcccttactccgttaaccggtttccgggacgggaacgggaaccgtaaggggttcggaagttaacgtaaaccgaaaacggttacgttggttacggctacgaaccaacctacgttccgttcgttccgttaaccg

SEQ ID NO: 340479 - DNA, 515 bp, Homo sapiens
  misc_feature: GZ8MTXP01AG24V.3.31.C09.1.454.CMB.2.raw
  modified_base (280)..(280): a, c, t, g, unknown or other
  misc_feature (280)..(280): n is a, c, g, or t
tcagagacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggcncccaggctcctcatctatgatgcatccaacagggccactggcatcccagccaggttcagtggcagtgggtctggggaacagcttcactctcaccatcagcagactggagcctgaagtatttgcagttgtattactgtcgaggtctatggttactcacctcggttcagtctttggccgaggggaaccaaggttggagatacgaaacgacgttgttggctgcaccattctgttcttc

SEQ ID NO: 340480 - DNA, 558 bp, Homo sapiens
  misc_feature: GZ8MTXP01DROEG.3.31.C09.1.454.CMB.2.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (414)..(414): a, c, t, g, unknown or other
  misc_feature (414)..(414): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaaggggaaangccaccctctcctgcagggccagtcagagtgttagcaactacttagcctggtaaccaaacagaaacctggccaggcncccaggctcctcatctatgatgcatcccaaacgacgggccacgtggccatccccagcctaggttcagtcggcaggtggtctgggaacagcttcactctcaccatcagcagcctagacgcctagaaacgtnttttgacttagtttattactgtacaggcaagcgtagcaacgtgccttctctacgtttcggcgggaacggaaccgtaagggttggaagacgtaacgaaacgttacgttggttacggctacggcaacctattctcgttccttaacg

SEQ ID NO: 340481 - DNA, 525 bp, Homo sapiens
  misc_feature: GZ8MTXP01DAUA0.3.31.C09.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (336)..(336): a, c, t, g, unknown or other
  misc_feature (336)..(336): n is a, c, g, or t
tcagagacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcaactacttagcctggtaccaaacagaaacctggccaggcncccaggctcctcatctatgatgcatccaacagggccactggcatcccagcaggttnagtggcagtggtctgggaacagcttcactctcaccatcagcagcctagagcctagaaagtattttgcctaagtttattactgtcagggtcaggccgtagcaacgtgcctactctacgtttcggcggagggaaccaaagggttggagatacaaagaacgttgttagctagcacctattcttcgttcttcc

SEQ ID NO: 340482 - DNA, 526 bp, Homo sapiens
  misc_feature: GZ8MTXP01DBXJE.3.31.C09.1.454.CMB.2.raw
  modified_base (204)..(204): a, c, t, g, unknown or other
  misc_feature (204)..(204): n is a, c, g, or t
tcagagacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcaactacttagcctggtaccaacagaaacctggccaggctcccaggctcctcatctatgatgcatccaacagggccactggcatcccagccaggttcagtggcagtggtctgggaacagcttcactctcaccatcagcagcctagagcctagaagtattttgctagtttattactgtcaggcagcgtagcaactggcctctctacgtttcgggcgggtagggaaccgaagggttgggaagagtacgaaaacggacgttggttcggctgcaccattcttcgttctttc

SEQ ID NO: 340483 - DNA, 534 bp, Homo sapiens
  misc_feature: GZ8MTXP01A798R.3.31.C09.1.454.CMB.2.raw
  modified_base (205)..(205): a, c, t, g, unknown or other
  misc_feature (205)..(205): n is a, c, g, or t
  modified_base (316)..(316): a, c, t, g, unknown or other
  misc_feature (316)..(316): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagctaactacttagcctggtaccaaacagaaacctggccaggcctcccaggcctcctcatctatgatgcatccaaacngggcccagtggcatcccagccaggttcagtcggcaggtgggtctgggaacagctnactcncaccancagcagcctagancctagaagtattttgacttagtttattactgtcaggctagcgtagcaacgtgcctctctacgttcggacggagggaaccagggttacggagacgtacgaaacgacgttggacggctggaaccacgattcctgttcttcc

SEQ ID NO: 340484 - DNA, 533 bp, Homo sapiens
  misc_feature: GZ8MTXP01BTD8Q.3.31.C09.1.454.CMB.2.raw
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaatacttagcctggtaccaanagaaacctggccaggcncccaggctcctcatctatgatgcatccaacagggccactggcatccccagccaggttcagtcggcagtgggtctgggaacagcttcactctcaccatcagcagcctagagcctagaagtattttgctagtttattactgtcagcagtcgtagcaacgtcggcctacgtcctacgtttccggcgggtacgggaaccgaagggttggagagtacgaaacgaacgttggttacggctgcacctattctgttccttc

SEQ ID NO: 340485 - DNA, 367 bp, Homo sapiens
  misc_feature: GZ8MTXP01DS53R.3.31.C09.1.454.CMB.2.raw
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (366)..(367): a, c, t, g, unknown or other
  misc_feature (366)..(367): n is a, c, g, or t
tcagagacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaaggcccatcggtcttcccctggcnccctgctccaggagcacctccgagagcacagccggccctgggctgcctggtcaaaggctacttccgagtgcgtctctgagcgggctggcaaggcncaatagnn

SEQ ID NO: 340486 - DNA, 606 bp, Homo sapiens
  misc_feature: GZ8MTXP01ESZUN.3.31.C09.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (587)..(587): a, c, t, g, unknown or other
  misc_feature (587)..(587): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccaggggaangccaccctntcctgcagggccagtcagagtgttagcaactacttagcctggtaccaaacagaaacctggccaggcncccaggctcctnatctatgatgcatccaagngggccacgtggccatcccagcctaggttcaggtcggctaggtggtctgggaacagtcttcactctacaccatcgagacacgtactaggactccgtaggtaagttagttttacgactttaagtttacttacgttcgtacacgggtacgtaggtacgtacgaccgtaacgtcggttacccttcgtccgttaccggtttacggggacggtaacgggaactaagggggttcgaaagttacgtaaacgaaacggttacgttgggttacggctcgctaaccgnttcgttcgttcgttaaccg

SEQ ID NO: 340487 - DNA, 529 bp, Homo sapiens
  misc_feature: GZ8MTXP01AJQZR.3.31.C09.1.454.CMB.2.raw
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccaatcagagtgttagcaactacttagcctggtaccaacagaaacctggccaggctcccaggcctcctcatctatgatgcatccaaacngggccactggcatccccagccaggttcagtcggcagtgggtctgggaacagcttcactctcacatcagcagcctagagcctgaagtattttgctagtttattactgtcaggtcagcgtagacaacgtggcctctctacgtttcgggacggtacgggaaccaagggttggaagagtaccgaaaagacgttggttggctgcaccattctgttcgttc

SEQ ID NO: 340488 - DNA, 693 bp, Homo sapiens
  misc_feature: GZ8MTXP01DJBSG.3.31.C09.1.454.CMB.2.raw
  modified_base (211)..(211): a, c, t, g, unknown or other
  misc_feature (211)..(211): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (457)..(457): a, c, t, g, unknown or other
  misc_feature (457)..(457): n is a, c, g, or t
tcagagacgcactccacgaccggtgctcgatttagacgtctcatcaaggaaggaaggggggaggaactgctcagttaggacccagagggaaccatggaagccccagctcagctttctcttcctcctgctactctggctcccagataccaccggagaaattgtgttgacacagtctccagcccaccctgtcttttgctccgaagggggaaanacgccaccctctcctgcagggccagtcagagtgttagcaactacttagcctaggtaccaacagaaacctggccaggcnccaggcctcctnatctatgatgcactacccaaagacgggccacgtggaccactccccgagccctaggttcaggtcggctagggtcgggtctaggggaaactacgtcttcaacttcctaccaccatcgaacgcctacgtacccgtaggacgtaccgttaggaaagtttntttttagacgtttaaattttacttaaccgttgttacgaacgggtcgtaacggtcgtaacgacctaaccggttcggtccccttacttaccgttaaccggtttccggggaccggggaaacggggtaacccgtaaagggggttggaaacgttaacgtaaaaccggtaaaacgttaacggttggttacgggaaccttaggcccttaaacccgttcgtttcccgttcgtttcccttaaccg

SEQ ID NO: 340489 - DNA, 526 bp, Homo sapiens
  misc_feature: GZ8MTXP01EE5WP.3.31.C09.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctntcctgcagggccagtcagagtgttagcaactacttagcctaggtaccaanagaaacctggccaggctcccaggctcctnatctatgatgcatccaacaggccacgtggcatcccgagccagttcagtcgcaggtggtctggaacagcttcactctcaccatcagcagcctagacgcctagaagtattttgctagtttatactgtcaggcagtcgtagcaacgtcgtcctactctacgtttcggcggtagggaaccgagggttggagacgtacgaaacgttacgttggttcggctgctacattcttgttcttcc

SEQ ID NO: 340490 - DNA, 568 bp, Homo sapiens
  misc_feature: GZ8MTXP01BC4KV.3.31.C09.1.454.CMB.2.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (410)..(410): a, c, t, g, unknown or other
  misc_feature (410)..(410): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccaggggaangccacctntcctgcagggccagtcagagtgttagcaactacttagcctggtaaccaanagaacctggccaggcncccaggcctcnatctatgatgcatccaacgagggccacgtggcactccccagcctaggttcaggtcggctaggtgggtctaggggaacagtcttcactctccactatcagcagcctagacgctagtaacgttntttgactagtttatactagtcaggctaggcgtagctaacgtcggtacctctcgtacgtttcgggagggacgggtaacgtaaggggttacggaagttacgtaacgaaacgttacgttggttacgggtctacggctacctattctaacgttcctttaacg

SEQ ID NO: 340491 - DNA, 554 bp, Homo sapiens
  misc_feature: GZ8MTXP01CJGJY.3.31.C09.1.454.CMB.2.raw
  modified_base (281)..(281): a, c, t, g, unknown or other
  misc_feature (281)..(281): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaatcagagtgttagcaactacttagcctggtaccaacagaaacctggccaggcnccccaggctcctcatctatgatgcatccaacgaggccactggcatcccagccaggttcagtcggcaggtgggtctggggaacagtcttcactctcaccatcagcagcctagacgcctgaagtatttgctagttattactgtacaggcagtcgtagacaacgtcggcctctctaccgtttcgggacgggtagggaaccgaagggttcgggaagagtaacgaaacgttaccgttggttcgggtctggaaccacctagttcttcggttcttaaccg

SEQ ID NO: 340492 - DNA, 364 bp, Homo sapiens
  misc_feature: GZ8MTXP01EEAJV.3.31.C09.1.454.CMB.2.raw
  modified_base (258)..(258): a, c, t, g, unknown or other
  misc_feature (258)..(258): n is a, c, g, or t
  modified_base (363)..(364): a, c, t, g, unknown or other
  misc_feature (363)..(364): n is a, c, g, or t
tcagagacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctcaccaaggcccatcggtctccccnggccgccctgctccaggagcacctcgagagcacagcggccctgggctgcctggtcaaggactacttccgagtgcgtctctgagcgggctggcaaggcgcaatagnn

SEQ ID NO: 340493 - DNA, 647 bp, Homo sapiens
  misc_feature: GZ8MTXP01AX3PO.3.31.C09.1.454.CMB.2.raw
  modified_base (207)..(207): a, c, t, g, unknown or other
  misc_feature (207)..(207): n is a, c, g, or t
  modified_base (459)..(459): a, c, t, g, unknown or other
  misc_feature (459)..(459): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaaggggaaanacgcccaccctctcctgcagggccagtcagtagtgttagcaactacttagcctaggtaaccaaacgaacgaaacctggacccaggcctccccgaggcctcctacacttctatgatgactaatacccgaaacgacggggcccaacgtgggaccactccccgagcccgtaggttcaggtcggcgagggtcgggtctggggaaactaggtcttcgactctaccaccatcagtcagcctagacgtcctagtaagtnttttacgactaaacttactattcgtacaaacggtagtacctttaaactacgttttaccctttaaagtccgttacggaaccgtaaagggtacctacggactagggaacgttaaacttaaacggacgttggtacggtcttacggcacccttaagtccttcttacttaccttacttcccgttccccgtaac

SEQ ID NO: 340494 - DNA, 559 bp, Homo sapiens
  misc_feature: GZ8MTXP01BCSMU.3.31.C09.1.454.CMB.2.raw
  modified_base (205)..(205): a, c, t, g, unknown or other
  misc_feature (205)..(205): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (403)..(403): a, c, t, g, unknown or other
  misc_feature (403)..(403): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccaatcagagtgttagcaactacttagcctggtaccaacagaaacctggccaggcncccaggctccncatctatgatgcatccaacngggccactggcatcccagccaggttcagtcggcaggtggtctgggaacagtcttcactctcacatcagcagcctagacgcctagaaacgttnttttgacttagtttattactgtcaggctaggcgtagactaacgtcggtccttctctacgtttcgggacgggagggaaccgtaagggttggaagacgtaacgaaacggttacgttggttcggtcgtcgcctactagttcctaacggttctttaaccg

SEQ ID NO: 340495 - DNA, 551 bp, Homo sapiens
  misc_feature: GZ8MTXP01CDZBR.3.31.C09.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaaggggaaagagccaccctctcctgcagggccagtcagagtgttagcaaactacttagcctggtaaccaaacagaaacctggccaggcncccaggctcctnatcaatgatgnatcaacaggcactgcanccagcagttcagtcgnagtggtcgtggaacgagctcactctcacactacagacacgacagacgactagaagtatttagtactagttattaactagtacaggacgagacgtacgacaacgtacggtcctacctctacgttcggtcggacgggaacggaaacggaggtagaagtaacgtaaacgaaacgttagttaggtcgtacgtaacactacttactcgttcgttc

SEQ ID NO: 340496 - DNA, 756 bp, Homo sapiens
  misc_feature: GZ8MTXP01EP786.3.31.C09.1.454.CMB.2.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccgaggggaancgccaccctctcctgcgagggccagtcagagtgttagcaactacttagcctaggtaacccaaanagaaacctggccaggcctcccgaggcctccacatctatgatgcactacccaaacgacggggacccaacgtcgggaccctaacgtcccccgaaggtcccctaaggggtttcccaaggggttcggggaccgtaaggggtcgggggttccgtacggggggaaaacctacgggtaaccttttccaaccgttccctacccaaaccgtattccgaacgtaccagtaccccgttaaggaccgtacccgttaggtaaaacggtttagttttttacgggacctttaaaggttttaactttaaccgttacggttaccgtaaggggtacgtaacgggtaccgggttaacgacccgtaaaccggttcgggtcccttacgttccgttaccggtttaccgggggacgggtaacggggaaccgtaaaggggttacggaacgttacgaacgaaacggttacgttggttacgggctcggaactacctattcgtcgttcttaaccg

SEQ ID NO: 340497 - DNA, 546 bp, Homo sapiens
  misc_feature: GZ8MTXP01EZRMP.3.31.C09.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctntcctgcagggccagtcagagtgttagcaactacttagcctaggtaacccaaacagaaacctggccaggctcccaggcctcctcatctatgatgcatccaaacgcgggccatggccactccccgagccaggttcagtcggcaggtggctgggaacagcttcactctcaccatcagcagcctagacgcctagtaagtattttgacttagtttattacgtgtcaggctagcgtagctaacgtcggtcctctcgtaccgttcgggcgggaagggaaccgaagggttggagagtaacgaaacggacgttggcggctgcaccgtattctcgttcttaac

SEQ ID NO: 340498 - DNA, 366 bp, Homo sapiens
  misc_feature: GZ8MTXP02HR3DJ.3.31.C09.1.454.CMB.2.raw
  modified_base (365)..(366): a, c, t, g, unknown or other
  misc_feature (365)..(366): n is a, c, g, or t
tcagagacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttcccctggcgccctgctcccaggagcacctccgagagcacagcggcccctgggctgcctggtcaaggactacttccgagtgcgtctctgagcggctggcaggcgcatagnn

SEQ ID NO: 340499 - DNA, 516 bp, Homo sapiens
  misc_feature: GZ8MTXP02JHQN6.3.31.C09.1.454.CMB.2.raw
  modified_base (203)..(203): a, c, t, g, unknown or other
  misc_feature (203)..(203): n is a, c, g, or t
tcagagacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctctcctgcagggccagtcagagtgttagcaactacttagcctggtaccaacagaaacctggccaggctcccaggctcctcatctatgatgcatccaacagggccactggcatcccagccaggttcagtcggcagtggtctgggacagcttcactctcaccatcagcagactggacgcctgaagtatttgctagtgtattactgtcaggtctatggttactcacctcggttcagtctttggccgagggaccagggtggaagtactacgaaacgtaacgtggtaggcgtgcaccgtatcctcgtcttcg

SEQ ID NO: 340500 - DNA, 514 bp, Homo sapiens
  misc_feature: GZ8MTXP02F79LQ.3.31.C09.1.454.CMB.2.raw
  modified_base (310)..(310): a, c, t, g, unknown or other
  misc_feature (310)..(310): n is a, c, g, or t
  modified_base (395)..(395): a, c, t, g, unknown or other
  misc_feature (395)..(395): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccaatcagagtgttagcaactacttagcctggtaccaacagaaacctggccaggctcccaggctcctcatctatgatgcatccaangggccactggcatcccagccaggttcagtgcagtgggtctggggacagcttcactctcaccatcagcagcctagagcctgaagtnttttgctagtttatactgtcagcagcgtagcaactggcctctcacgtttcggcgggagggaccgaagggtcggaagtatacgaaaacgaacgtgtacggctgcacctagtctgtcttac

SEQ ID NO: 340501 - DNA, 523 bp, Homo sapiens
  misc_feature: GZ8MTXP02GHG2Z.3.31.C09.1.454.CMB.2.raw
  modified_base (203)..(203): a, c, t, g, unknown or other
  misc_feature (203)..(203): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccagggaangccacctctcctgcagggccagtcagagtgttagcaactacttagcctggtaccaacagaaacctggccaggctcccaggctcctcatctatgatgcatccaacagggccacgtggcactccccagccagggttccaggtggcaggtgggtctggggaccaggcttcactctcaccatccagcagccctagacgctagaagtntttgctagtttatactgtcagcagngtagcaactggccctntctacgtttcgggcggaggaccgagggtggacgatacgaaacgtacgtggtacggctgacaccgatctcgtcttac

SEQ ID NO: 340502 - DNA, 540 bp, Homo sapiens
  misc_feature: GZ8MTXP02GYQWN.3.31.C09.1.454.CMB.2.raw
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (296)..(297): a, c, t, g, unknown or other
  misc_feature (296)..(297): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaaggggaaagagccaccctctcctgcagggccagtcagagtgttagcaactacttagcctggtaccaaanagaaacngcagcnccagctcnatntatnanncanacaanaggcangcanccancagtcagngnagtggtcgtggacagctcactctacacanacanacacactagagactagtaagtattagtatagtttaatttacttagtacagacagacgtagacaacgtacgtcctctctacgttacggtacgggacgggaacggaaacggtaggaaggaacgtaaacgaaaacgaaaacgtacgtaggtaacgtacgacgaccaactactacgttcttc

SEQ ID NO: 340503 - DNA, 502 bp, Homo sapiens
  misc_feature: GZ8MTXP02GZ6RS.3.31.C09.1.454.CMB.2.raw
  modified_base (204)..(204): a, c, t, g, unknown or other
  misc_feature (204)..(204): n is a, c, g, or t
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
  modified_base (435)..(435): a, c, t, g, unknown or other
  misc_feature (435)..(435): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccaggggaaanagccacctctcctgcagggccagtcagagtgttagcaactacttagccttggtaccaacagaaacctggccaggctcccaggctcctcatctatgatgcatccaacaggccatggcatcccagccaggtcagtggcagtgggtcnggggacagcttcactctcaccatcagcagcctagagcctgaagnttttgctagtttatactgtcagctagcgtagcaactggcctntcactttcggcgagggaccaaggtgacgatacgaaaacgactgtaggctagacaccatctcgtcttc

SEQ ID NO: 340504 - DNA, 554 bp, Homo sapiens
  misc_feature: GZ8MTXP02HA7ZP.3.31.C09.1.454.CMB.2.raw
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccagaggaaagagccaccctctcctgcagggccagtcagagtgttagcaactattagcctggtaccaacagaaacctggccaggctcccaggctcctcatctatgatgcatccaacgagggccacgtggcactcccagccaggtcagtgcagtggtctgggacngacttnactctcacntcancanctagnctgaatatttgctagtttattactgtcagtcagtcgtagctaacgcggtacctctctacgtttcgggaccggtaacgggaaccgaaggggtacggaaaggtaacgtaaccgaaaaacggtaacgtagggtaacggcgttacggaccaaccctattccgttacgtttccg

SEQ ID NO: 340505 - DNA, 514 bp, Homo sapiens
  misc_feature: GZ8MTXP02GWBZR.3.31.C09.1.454.CMB.2.raw
  modified_base (308)..(308): a, c, t, g, unknown or other
  misc_feature (308)..(308): n is a, c, g, or t
  modified_base (435)..(435): a, c, t, g, unknown or other
  misc_feature (435)..(435): n is a, c, g, or t
tcagagacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccagggaaagagccacctctcctgcagggccagtcagagtgtagcaactacttagcctggtaccaacagaaacctggccaggctcccaggctcctcatctatgatgcatccaacnggccactggcatcccagccaggttcagtcggcagtgggtctggggacagcttcactctcaccatcagcagcctagagcctgaagtatttgactagtttatactgtcagcagcgtagcaactggcctntctacgtttcggcggtaacgggaccgaaaggtggaacgagtacgaaaacgactgtaggcctgcaccatctcgtctttac

SEQ ID NO: 340506 - DNA, 544 bp, Homo sapiens
  misc_feature: GZ8MTXP02JUHJQ.3.31.C09.1.454.CMB.2.raw
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (373)..(373): a, c, t, g, unknown or other
  misc_feature (373)..(373): n is a, c, g, or t
  modified_base (403)..(403): a, c, t, g, unknown or other
  misc_feature (403)..(403): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcaactacttagcctggtaccaanagaaacctggccaggcctcccaggcctcctcatctatgatgcatccaacagggccactggcactcccagccaggttcagtcggcaggtggtctgggacagcttcactcncacatcagcacgcctagacgcctagaagtntttcgactagtttatactgtcagctagcgtagacaacgtcgacctctctacgtttcgggacggtaacgggaccgaaagggtcggagacgtaacgaaaacggtacgtggacggtctacggaccacgtatcgtacgtcttacg

SEQ ID NO: 340507 - DNA, 550 bp, Homo sapiens
  misc_feature: GZ8MTXP02JW6FZ.3.31.C09.1.454.CMB.2.raw
  modified_base (205)..(205): a, c, t, g, unknown or other
  misc_feature (205)..(205): n is a, c, g, or t
  modified_base (385)..(385): a, c, t, g, unknown or other
  misc_feature (385)..(385): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagagtgttagcaactacttagcctggtaccaacagaaacctggccaggctcccaggcctcctcatctatgatgcatcccaaacgagggcccacgtggcctaactccccagccctaggttcaggtcggcaggtggggtctggggacagcttcactcncaccatcagcagcctagacgcctagaacgtatttgacttaagtttattacttgtcagtcagcgtagcaacgtcggcctctctacgtttcgggacggacgggaccgaagggtggaacgacgtacgaaaacgtacgtggtaggctgaccactacgtcttcgtccttc

SEQ ID NO: 340508 - DNA, 519 bp, Homo sapiens
  misc_feature: GZ8MTXP02HRPAO.3.31.C09.1.454.CMB.2.raw
  modified_base (333)..(333): a, c, t, g, unknown or other
  misc_feature (333)..(333): n is a, c, g, or t
tcagagacgcactccacgaccggtgctcgatttagacgtctcatcaaggaaggaagggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctggcggggccagtcagagtgttcccagcaactatatagcctggtaccagcacaagtgcctggcgcccaggctcctcatctatgatacattcaccagggccactggcatcccgganaggttcagacgcagtgggtatgggacagcttcactctcaccatcagcagactggacgccgtaggagtattttggctagtttattactgtactagctagtatggtacttcacaaaccttcggacgaggggacacgacgtaggagtagttaacgcgaaactgtcggctgcacatctgtctctacttcc

SEQ ID NO: 340509 - DNA, 508 bp, Homo sapiens
  misc_feature: GZ8MTXP02JEFHT.3.31.C09.1.454.CMB.2.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgtagcaactcttagcctggtaccaanagaaacctggccaggctcccaggctcctcatctatgatgcatccaacagggccactggcatcccagccaggttcagtggcagtggtctgggacagcttcactctcaccatcagcagcctagagcctgaagtatttgctagttattactgtcagcagcgtagcaacgtcggcctctctacgtttcggcggagggaccgaagggtggagagtacgaaacgactgtaggctggcacatctcgtctttac

SEQ ID NO: 340510 - DNA, 521 bp, Homo sapiens
  misc_feature: GZ8MTXP02JCO59.3.31.C09.1.454.CMB.2.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (410)..(410): a, c, t, g, unknown or other
  misc_feature (410)..(410): n is a, c, g, or t
  modified_base (502)..(502): a, c, t, g, unknown or other
  misc_feature (502)..(502): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgtagcaactacttagcctggtaccaacagaaacctggccaggctcccaggctccncatctatgatgcatccaaacaggggccacgtggcatccccagcccaggttcagtcggacaggtgggtctggggacagtccttcactctcaccatccagcagcctagacgcctagaagtntttgctagtttattactgtcagcagcgtagcaaacgtcggcctctcacgtttcggcggacgggaccgaaggtggacgatacaaacgactggngcgtgacacatctcgtctc

SEQ ID NO: 340511 - DNA, 502 bp, Homo sapiens
  misc_feature: GZ8MTXP02FQ015.3.31.C09.1.454.CMB.2.raw
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (398)..(398): a, c, t, g, unknown or other
  misc_feature (398)..(398): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaanagaaacctggccaggctcccaggctcctcatctatgatgcatccaanagggccactggcatcccagccaggttcagtcgcagtgggtctggggacagcttcactctcaccatcagcagcctagagcctgaaagnttttgctagtttatactgtcagtcagcgtagcaactggcctctcactttcggcgagggaccaggtgagatacgaaacgaactgtggctgacacatctgtcttac

SEQ ID NO: 340512 - DNA, 532 bp, Homo sapiens
  misc_feature: GZ8MTXP02F45HR.3.31.C09.1.454.CMB.2.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcaactacttagcctggtaccaanagaaacctggccaggctcccaggctcctcatctatgatgcatccaacagggccactggcatcccagccaggttcagtggcagtgggtctggggacagcttcactctcaccatcagcagccctagacgccctgaaagtatttttagcttaagttttattacttgtctagcagcgtagcaacgtggcctctctactttcgggcggtagggaccgaggtggacgagtacgaaaacgactggtcggcgtcggctaccgatccgtgtctttacc

SEQ ID NO: 340513 - DNA, 510 bp, Homo sapiens
  misc_feature: GZ8MTXP02GTQCW.3.31.C09.1.454.CMB.2.raw
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaatcagagtgttagcaactacttagcctggtaccaacagaaacctggccaggctcccaggctcctcatctatgatgcatccaacaggccactggcatcccagccaggttcagtggcagtggtctgggacagcttcactctcaccatcagcagcctagagcctgaacgtattttgctagtttattactgtcagcagcgtagcaactggcctctctactttcgggcggagggaccaagggtggaacgatacgaaaacgacgtaggtggctgcacgatctgtcttc

SEQ ID NO: 340514 - DNA, 494 bp, Homo sapiens
  misc_feature: GZ8MTXP02GOTUZ.3.31.C09.1.454.CMB.2.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (435)..(435): a, c, t, g, unknown or other
  misc_feature (435)..(435): n is a, c, g, or t
  modified_base (489)..(489): a, c, t, g, unknown or other
  misc_feature (489)..(489): n is a, c, g, or t
tcagagacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtcttgtctccaggggaaanagccaccctctcctgcagggccagtcagagtgttagcaactacttagcctggtaccaanagaaacctggccaggctcccaggctcctcatctatgatgcatccaaacngggccactggcatcccagccaggttcagtgcagtgggctggggacagcttcactctacaccatcagcagcctagagcctgaagattttgctagttattactgtcagcagctagcaactggctcncacttcggcggaggaccaaggtgagatacaaacgactagtgaactgcaccatcngtctc

SEQ ID NO: 340515 - DNA, 512 bp, Homo sapiens
  misc_feature: GZ8MTXP02I6W1B.3.31.C09.1.454.CMB.2.raw
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcaactacttagcctggtaccaacagaacctggccaggctcccaggctcctcatctatgatgcatccaanggccatggcatcccagccaggtcagtcgcagtggctgggacagcttcactctcaccatcancagcctagagcctagaagtntttgctagtttattactgtcagcagcgtagcaacgtggcctctctacgtttcggacggaggtaccgaagggtcggagactacgaaacgtaacgtgtacggctcgacacgatctacgtcttac

SEQ ID NO: 340516 - DNA, 509 bp, Homo sapiens
  misc_feature: GZ8MTXP02J2ZV3.3.31.C09.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctccaggggaanagccaccctctcctgcagggccagtcagagtgttagcaactnttagcctggtaccaacagaaacctggccaggctcccaggctcctcatctatgatgcatccaacaggccactggcatcccagccaggtcagtcgcagtggtctggacngctcactcncacatcagcagcctagacgcctagagtatttgctagtttatactgtcagcagcgtagcaactggcctctctacgtttcggacgggtaggaccgaagggtggaacgatacgaaacgacgtgtaggctgacaccgtatcgtcgtcttacg

SEQ ID NO: 340517 - DNA, 496 bp, Homo sapiens
  misc_feature: GZ8MTXP02GO260.3.31.C09.1.454.CMB.2.raw
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagtctttgtctccaggggaaanagccaccctctcctgcagggccagtcagagtgttagcaactacttagcctggtaccaanagaaacctggccaggctcccaggctcctcatctatgatgcatccaangggccactggcatcccagccaggttcagtcgcagtgggtctgggacagctcactctcaccatcagcagcctagagcctgaagattttgctagtttatactgtcagcagcgtagctaactgcctctcaccttcggcggaggaccaaggtganagtacaaacgactgnggctgacaccntctctctc

SEQ ID NO: 340518 - DNA, 566 bp, Homo sapiens
  misc_feature: GZ8MTXP02F2RYC.3.31.C09.1.454.CMB.2.raw
  modified_base (206)..(206): a, c, t, g, unknown or other
  misc_feature (206)..(206): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcaactacttagcctggtaccaacagaaacctggccaggctcccaggctcctcatctatgatgcatccaacagggccactggcactcccgagcccaggttcaggtcggcaggtgggtctgggacagtccttcactctccaccatcagcagccctagacgcctgaagtattttgactagtttattactgtcagcagcgtagcaacgtcgtcctctactaccgtttcgggacggacgggaccgtaaggggtaggacgtaacgttacgaaaaccggtaacgtggttacgggctacggacctaaccgtattccgttagttcctttaccg

SEQ ID NO: 340519 - DNA, 555 bp, Homo sapiens
  misc_feature: GZ8MTXP02H7RFB.3.31.C09.1.454.CMB.2.raw
  modified_base (287)..(287): a, c, t, g, unknown or other
  misc_feature (287)..(287): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctccaggggaagagccaccctctcctgcagggccagtcagagtgttagcaactactagcctggtaccaacagaacctggccaggctccaggctccncatctatgatgcatccaaacacgggccaacgtggccactcccagcctaggttcaggtggcaggtgggtctggggacagtcttcactctcaccntcagcagcctagacgcctagtaagtnttttgactaagtttattactgtacagctagcgtagacaacgtcggacctctctacgtttcggacgggtacgggaaccgtagggtaggacgtaacgtaacgaaaacgaaacgtggacggtcgtacgacgacctatccgtagttaccttac

SEQ ID NO: 340520 - DNA, 517 bp, Homo sapiens
  misc_feature: GZ8MTXP02GJFTI.3.31.C09.1.454.CMB.2.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
  modified_base (396)..(396): a, c, t, g, unknown or other
  misc_feature (396)..(396): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagagtgttagcaactacttagcctggtaccaanagaaacctggccaggctcccaggctcctcatctatgatgcatccaagagggccactggcatcccagccaggttcagtgcagtggtctggggacagcttcactctcaccatcagcagcctagacgcctagaacgnttttgctagtttattactgtacagcagcgtagcaacgtcggacctctctaccgttcggacggacgggaccaagggtggacgaatacgaaacgactggngctcgacactntctacgtcttac

SEQ ID NO: 340521 - DNA, 366 bp, Homo sapiens
  misc_feature: GZ8MTXP02IUQAT.3.31.C09.1.454.CMB.2.raw
  modified_base (364)..(366): a, c, t, g, unknown or other
  misc_feature (364)..(366): n is a, c, g, or t
tcagagacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttcccctggcgccctgctccaggagcacctccgagagcacagcggcccctgggctgcctggtcaaggactactccgagtgcgtctctgagcggctggcaaggcgcatagnnn

SEQ ID NO: 340522 - DNA, 533 bp, Homo sapiens
  misc_feature: GZ8MTXP02HRMYU.3.31.C09.1.454.CMB.2.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcaactacttagcctggtaccaacagaaacctggccaggcctcccaggctcctcatctatgatgcatccaanagggccagtggcatcccagccaggttcagtgcaggtggtctggggacagtcttcactctcacatcagcagcctagacgcctagaaagtattttgactagttttatacgtgtcaagtcagcgtagcaagtcggcctactctaccgtttcgggacgggtaacggaccgaaagggtggaacgagtacgaaaacgacgtgtcggctcgacaccatcctgtctccg

SEQ ID NO: 340523 - DNA, 638 bp, Homo sapiens
  misc_feature: GZ8MTXP02JSQF1.3.31.C09.1.454.CMB.2.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgtagcaactacttagcctggtaccaacagaaacctggccaggctcccaggctcctnatctatgatgcatccaacgagggccacgtggcactcccagcctaggttcaggtcggcagtgggtctggggacagcttcactctcacntcagcagcctagacgccctagaagtattttacgactagttttacttacgttggttcaaggttccaaggtccgttaagaccgtaaaccgttcgggtaccccttccgtaccgtaccggttttaccgggggacgggaacgggggtaaacccgtaagggggttacgggaaaggtacgttaaaccgaaaaacgggtacctacgggttacggggtccacggtaccctaaacccgtacggtttaccttacggttcccgttttaccg

SEQ ID NO: 340524 - DNA, 544 bp, Homo sapiens
  misc_feature: GZ8MTXP02I4W7H.3.31.C09.1.454.CMB.2.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctctcctgcagggccagtcagagtgttagcaactacttagcctggtaccaanagaacctggccaggctccaggctctcatctatgatgcatcccaacncgggccacgtcggaccactcccagcctaggttcagtcggcaggtcgggtctgggacagcttcactctcaccatcagcagcctagacgctagacgttattttcgacttagtttattactgtacagctagcgtagactaacgtggccttcgtctacgttcgggacggtacggtaccgagggtcgaagtacgtaacgaaacgtacgtggtacgcgtcgaccacgtatcgtcgttactttc

SEQ ID NO: 340525 - DNA, 539 bp, Homo sapiens
  misc_feature: GZ8MTXP02I5VE2.3.31.C09.1.454.CMB.2.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
  modified_base (513)..(513): a, c, t, g, unknown or other
  misc_feature (513)..(513): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagcccaccctgtctttgtctccaggggaanagccaccctctcctgcagggccagtcagagtgttagcaactacttagcctggtaccaacagaaacctggccaggctcccagctcctcatctatgatgcatccaaacnggccactggcatcccagccaggttcagtcggcaggtggtctgggacagcttcactcacaccatcagcagcctagacgcctagaagtatttagcgttaagtttattacgtagtacagtacagtcgtagactaacgtcggaccttctactacgtttcgggacggtacgggaccgaagggtaggagaagtacgaaacgacgtgnggcgtcgacacacgtctcgtcttacg

SEQ ID NO: 340526 - DNA, 575 bp, Homo sapiens
  misc_feature: GZ8MTXP02HT17Y.3.31.C09.1.454.CMB.2.raw
tcagagacgcactccacgaccggtgctcgatttagacgtctcatcaaggaaggaagggggaggaactgctcagttaggacccagagggaaccatggaagccccagctcagctttctcttcctcctgctactctggctcccagataccaccggagaaattgtgttgacacagtctccagccaccctgtctgtgtctccgaggggagagagccaccctctcctgcagggccagtcagagtgttgacagcaacttggcctggtaccagcagcaacctggcccaggcctcccaggcctcctcatctatgatgcactcccacgacggggccaccggtatccccgagccctaggttcagtggctaggtcggggtctgggggacaggtacgttccactcctcacccatcagcacgcctgcagtctgtaggtatttgcttagttttattactgtcagtactaattaacaattaacgtcggtacccttcggcttacgtacgtttcggggacgggtaacgggaaccgtaaagggtacgggagtaacgtacgaaaacgtaacgtggtacggctacggaccactacg

SEQ ID NO: 340527 - DNA, 518 bp, Homo sapiens
  misc_feature: GZ8MTXP02IDGJD.3.31.C09.1.454.CMB.2.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcaactacttagcctggtaccaacagaacctggccaggctccaggctccncatctatgatgcatccaaacnggccacgtggcactcccagcccaggttcagtgcagtggctgggacngcttcactctcaccatcagcagcctagacgcctgaagtntttgcttagtttatatgtcagctgcgtagcaatcggcctctctacgttcggcggaacggaccgaaaggtggagtaacgtacaaaacgacgttggacgcgtagacctacagtctagttcctttc

SEQ ID NO: 340528 - DNA, 717 bp, Homo sapiens
  misc_feature: GZ8MTXP02JHY34.3.31.C09.1.454.CMB.2.raw
  modified_base (205)..(205): a, c, t, g, unknown or other
  misc_feature (205)..(205): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagtctttgtctccaggggaaanagccaccctctcctgcagggccagtcagagtgtagcaactacttagcctggtaccaacagaaacctggccaggctcccaggctcctcatctatgatgcactcccaaacgcgggcccaacgtgggacccaactcccccgaaggtccccgtaaggggtttacccaaggttccggggcctaaggggtttcggggtaccgttgggggaacctagggtacctttccgaaccttccgtacccaacctatccacgccaacgtcccgttaagacgtacccgttaggtaaacgttagttttacggactttaaggttttaactttaccgttaggttaccgaaggtccgaaggtaccggttacggacctaaacgtcgggtccctttacgtactaccggtttaccgggacgggtaacgggaaccgtaaggggtacggacgtaaacgtacgtaaaaacgggtaccttagggtacgggtaacctggaacccgtaccgtaacttccggtttacgttccgtttaaccg

SEQ ID NO: 340529 - DNA, 626 bp, Homo sapiens
  misc_feature: GZ8MTXP02HN52Z.3.31.C09.1.454.CMB.2.raw
  modified_base (204)..(204): a, c, t, g, unknown or other
  misc_feature (204)..(204): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtgttagctaactcttagcctggtaccaacagaacctggaccaggcctacccaggtcctcctcatctatgatgcatccaaagacggccaacgtggacactcccagcctaggttcagtcggcaggtggtctgggacagtcttcactctccacatcagcagcctagacgacctagtaagtattttagacgttaagtttacttacgttagttcgagtaccgtagtacgtacggacctaaacgttcggtcctaccgttcgtaaccggtttccggggacggggtaacggggtaaccgtaaagggggttaggaacggtaaacgtaaaccggtaaaacggtaaccgttaggttcgggaaccgtacggaccctaccgtattaccgttacgttccttttaccg

SEQ ID NO: 340530 - DNA, 533 bp, Homo sapiens
  misc_feature: GZ8MTXP02JHNOH.3.31.C09.1.454.CMB.2.raw
  modified_base (360)..(360): a, c, t, g, unknown or other
  misc_feature (360)..(360): n is a, c, g, or t
  modified_base (521)..(521): a, c, t, g, unknown or other
  misc_feature (521)..(521): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccagaggaaagagccaccctctcctgcagggccagtcagagtgttagcaactcttagcctggtaccaacagaaaccttggccaggctccaggctcctcatctatgatgcatccaacacgggccactggccatcccagccaggttcagtggcagtgggtctgggacngacttcactctcacatcagcagcctagagcctagagtatttgctagtttattactgtcagtcagcgtagcgaactcggactctctacgtttcgggacggtacgggtaccgagggtcggaagtacgtacgaaaacgtaactggtaacggactcgccgaaccncttcgtgtttcc

SEQ ID NO: 340531 - DNA, 507 bp, Homo sapiens
  misc_feature: GZ8MTXP02F0NI9.3.31.C09.1.454.CMB.2.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccaggggaangccacctctcctgcagggccagtcagagtgttagcaactcttagcctggtaccaanagaaacctggccaggctcccaggctcctcatctatgatgcatccaacngggccacgtggcatcccagccaggttcagtcgcagtggtctgggacagcttcactctcaccatcagcagcctagacgcctagaacgtattttgacttagtttattacttgttcagtcagcgtagcaactggcctctctacgttcggcggaggaccgaggtgagactacgaaacgactgtaggctgacacatctcgtcttc

SEQ ID NO: 340532 - DNA, 787 bp, Homo sapiens
  misc_feature: GZ8MTXP02HIREF.3.31.C09.1.454.CMB.2.raw
  modified_base (207)..(207): a, c, t, g, unknown or other
  misc_feature (207)..(207): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagttctttgtctccgaggggaaanagccaccctctcctgcagggccagtcagagttgttagcaactacttagcctggtaccaacagaaacctggccaggcctcccaggctcctcatctatgatgcactcccaaacgacgggccacgtggaccaacttcccccgaaggcccctaaggggtttccaagggttccggggaccgtagggttcgggggtccgtagggggaacctaagggtaccttttccaaccttccttacccaaccctatccgaacgccaagccccttaaaggacgtacccttaaggaaaacggtttactttttcggaacctttaaaggttttttaactttaacccgttagggttacccaaagggtacccgaaggtaccgggtttaacggaccctaaaaccggttccgggacccctttcccgttacgttaacccggttttccgggggaccggggaaaccgggggtaaaccctaaaggggggttaggaaacggttaacgttaaaccggaaaaaccggtaaaccggttggggtttaacgggccgtttacgggacccctaaaacccgttacgtttacccgtttacggtttaccctttaccg

SEQ ID NO: 340533 - DNA, 594 bp, Homo sapiens
  misc_feature: GZ8MTXP02IHLQP.3.31.C09.1.454.CMB.2.raw
  modified_base (204)..(204): a, c, t, g, unknown or other
  misc_feature (204)..(204): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctctcctgcagggccagtcagagtgttagcaactacttagcctggtaaccaacagaaacctggccaggctcccaggctcctcatctatgatgcatccaacgacggccacgtggaccactccccagcccaggttcaggtcggctaggtcgggtctggggaccaggtccttcactctaccaccatcagcagccctagacgcctagaagtacttttggacttagtttactactgttacagcagtcgtagacctaacgtcggaccttctacgtacgtttacgggacgggtaacgggtacccgtaaaaggggtggaacggtaactaaccgtaaaacgtaacgttcggttaacggcgttacgaccgtaccctagtccttcgttactttccc

SEQ ID NO: 340534 - DNA, 535 bp, Homo sapiens
  misc_feature: GZ8MTXP02JHGVZ.3.31.C09.1.454.CMB.2.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (429)..(429): a, c, t, g, unknown or other
  misc_feature (429)..(429): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgtagcagctacttagcctggtaccagcagaaacctggccaggctcccaggctcctcatttangatgcatccaacngggccacgtggcatcccagccaggttcaggtgcagtgggtctggggacngcttcactctcacatcagcacgcctagacgcctagagtatttgactagtttatactgtacagcagcgtanccgaacgtcggcctctcgtaccgttcgggacggacgggaccaaggggtcggaagacgtaccgaaaacgtacgtcggtggactacggccaacgtctcgtcgtttacc

SEQ ID NO: 340535 - DNA, 541 bp, Homo sapiens
  misc_feature: GZ8MTXP02JW53I.3.31.C09.1.454.CMB.2.raw
  modified_base (313)..(313): a, c, t, g, unknown or other
  misc_feature (313)..(313): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccgaggctcctcatctatgatgcatccaacnggccagtggcactcccagccaggttcaggtcggcaggtggtctgggacagcttcactctcaccatcagcacgcctagcgcctagtagtatttgcttagtttattactgtacagcagcgtagacaacgtcggcctctctacgtttcgggcggacggaccgaagggtggaacgtactacgaaacgtacgtggtacggcgtacggaccacgtatccgttcgtactttaccg

SEQ ID NO: 340536 - DNA, 518 bp, Homo sapiens
  misc_feature: GZ8MTXP02JHERB.3.31.C09.1.454.CMB.2.raw
  modified_base (206)..(206): a, c, t, g, unknown or other
  misc_feature (206)..(206): n is a, c, g, or t
  modified_base (290)..(290): a, c, t, g, unknown or other
  misc_feature (290)..(290): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (489)..(489): a, c, t, g, unknown or other
  misc_feature (489)..(489): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggcctcccagataccaccggagaaattgtgttgacacagtctccagccaccctgtctttgtctccaggggaaangccaccctctcctgcagggccagtcagagtgtagcaactacttagcctggtaccaacagaaacctggccaggctccaggctccncatcatgatgcatccaagagggccacgtggccatccccagccaggttcaggtcgcagtggtctgggacagcttcactctcacatcagcacgctagcnctagactnttgcttagttatacgtgtcagtcagcgtagctaacgtcgcctctcgtacgttcggcggaggaccgaggtagacgatacgaacgacgtggtacgngtacgaccgactactacgtcgttacttac

SEQ ID NO: 340537 - DNA, 580 bp, Homo sapiens
  misc_feature: GZ8MTXP02FWET5.3.31.C09.1.454.CMB.2.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcaactacttagcctggtaccaanagaaacctggccaggctcccaggctcctcatctatgatgcatccaacagggccacgtggcatcccagccaggttcaggtcggcaggtgggtctggggacagtccttcactctccaccatcagcacgcctagacgcctagtaacgtattttcgacttagtttattacgttagtacagcagacgttagactaacgtcggaccttcgtacctacgtttcgggacgggtaacggggaccgtaaggggtcggaacggaacgttaacgaaaacggtaacgtggtacggtcgtacgaccacctagtccgttcgttcctttaccg

SEQ ID NO: 340538 - DNA, 554 bp, Homo sapiens
  misc_feature: GZ8MTXP02JLISM.3.31.C09.1.454.CMB.2.raw
  modified_base (207)..(207): a, c, t, g, unknown or other
  misc_feature (207)..(207): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (543)..(543): a, c, t, g, unknown or other
  misc_feature (543)..(543): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaangcccaccctctcctgcagggccagtcagagtgtagcaactacttagcctggtaaccaacagaaacctggaccaggctcccaggcctcctcatctatgatgcatccaaacgagggccacgtggccatccccagccaggttccagtcggctagggtcggtctggggacnggtacttcactctaccacatcagcagcctagacgctagaaagtntttgcttagtttatactgtcaggcagcgtagacaacgtgtaccctgtcgtacgtttcggggacggaagggtaccgaaggggtggaaacgtataacgaaaacgtactggtacggctagactacctntctcgtactcg

SEQ ID NO: 340539 - DNA, 516 bp, Homo sapiens
  misc_feature: GZ8MTXP02IMLB6.3.31.C09.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccaggggaangccacctctcctgcagggccagtcagagtgttagcaactacttagcctggtaccaacagaacctggccaggctccaggctcctcatctangatgcatccaacnggccatggacactcccagccaggttcaggtcggcagtgggtctgggacagcttcactctcaccatcagcagcctagacgctagaatatttgacttagtttattactgtctagcagtcgtagactacgtcggtcctcgtctcgtttcggcggtacgggactagggtgagtagtacgaacgaacgtgtacgcgtcgacactatctcgtcttc

SEQ ID NO: 340540 - DNA, 515 bp, Homo sapiens
  misc_feature: GZ8MTXP02FI3V3.3.31.C09.1.454.CMB.2.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (487)..(487): a, c, t, g, unknown or other
  misc_feature (487)..(487): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcaactacttagcctggtaccaacagaacctggccaggctcccaggctcctnatctatgatgcatccaanggccactggcatcccagccaggttcagtcgcagtgggtctgggacagctcactctcaccagtcagcagcctagacgctgaagtacttttgactagtttatactgtcagtcagcgtagcaacgtggcctctctacgttcggcggtacgggaccaagggtggaacgatacgaaacgtacnggtcggaactgacacctatctctcttac

SEQ ID NO: 340541 - DNA, 566 bp, Homo sapiens
  misc_feature: GZ8MTXP02H86D6.3.31.C09.1.454.CMB.2.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctccaggggaanagccaccctctcctgcagggccagtcagagtgttagcaatacttagcctggtaaccaacagaaacctggccaggctccagctcctcatctatgatgcatccaanaggccaacgtggcatcccagccaggtcagtcgcagtgggctgggacagcttcactctcaccatcagcagaccgtagcgtacgtagaagtttatttggacttaagttttacaacgttagtacgagtacgtagacgtacgactacgtcgtacctcgtaccgttacggttacggggacggtaacggaacgtagggtacgaagtaaactaaacggaaaacgtacgttggacgtaacgacgaactactgtcttacgtccttacg

SEQ ID NO: 340542 - DNA, 599 bp, Homo sapiens
  misc_feature: GZ8MTXP02GPNKY.3.31.C09.1.454.CMB.2.raw
  modified_base (206)..(206): a, c, t, g, unknown or other
  misc_feature (206)..(206): n is a, c, g, or t
  modified_base (423)..(423): a, c, t, g, unknown or other
  misc_feature (423)..(423): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtgttagctaactacttagcctggtaaccaacagaaacctggaccaggcctccaggcctcctcatctatgatgcatcccaacgacgggccacgtggaccactcccagccaggtcagtcggctaggtcgggtctggggactagccttcactcctacaccatcagacagtcctagacgccgtagaagttntttgacttagtttatacgtgtacagtcgtagcgttacgactaacgtcggtcccttcgtaccgttacggtttccggggacggggtaacgggtaccgtaaggggttcggaacgtacgtaacgaaaacggtacgttggtacgggaacttcggacctacgtattcgttcgttaccttacg

SEQ ID NO: 340543 - DNA, 529 bp, Homo sapiens
  misc_feature: GZ8MTXP02HETJG.3.31.C09.1.454.CMB.2.raw
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
  modified_base (387)..(387): a, c, t, g, unknown or other
  misc_feature (387)..(387): n is a, c, g, or t
  modified_base (439)..(439): a, c, t, g, unknown or other
  misc_feature (439)..(439): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccagggaaangccacctctcctgcagggccagtcagagtgttagcaactcttagcctggtaccaacagaaacctggccaggctccaggctccncatcatgatgcatccaaacgaggccactggcactcccagccaggttcagtcggcaggtgggtctggggacagtacttcactctcaccatcagcagcctagngcctagaatatttgactagtttatacgtgtacagcagcgtagcacgtgcctntcgtacgttcggcggaacggaccgaaagggtggaacgataacgaaacgtaactggtaggcctggacctaccgatcgtacgtttcctaccg

SEQ ID NO: 340544 - DNA, 531 bp, Homo sapiens
  misc_feature: GZ8MTXP02I81UY.3.31.C09.1.454.CMB.2.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtgttagcaactacttagcctggtaccaacagaaacctggccaggctccaggctcctnatctatgatgcatccaanggccatggcatccagccagttcagtcggcaggtgggtctaggggacagtcttcacgtctcaccntccagcagcctagcgctagaagtntttgactagtttatactgtacagcagcgtacgcaactcggctacgtctacgttcggcggtacggaccgtaagggtcgagtaaactcgaaaacggtactggcggaactcgactaccgatttcctgttcctttacg

SEQ ID NO: 340545 - DNA, 618 bp, Homo sapiens
  misc_feature: GZ8MTXP02G7IYV.3.31.C09.1.454.CMB.2.raw
  modified_base (204)..(204): a, c, t, g, unknown or other
  misc_feature (204)..(204): n is a, c, g, or t
  modified_base (567)..(567): a, c, t, g, unknown or other
  misc_feature (567)..(567): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctcgaggggaaancgccacctctcctgcagggccagtcagagtgttagcaactacttagcctaggaccaaacagaaaacctggaccaggcctcccaggcctcctcatctatgatgacatacccaaagacgggacccaacgtggaccaactccccaaggcccgagggtttcaagggtcgggcgtagggtggggttcgtggggaacaaggtaccttcaacttcctacaaccctatccaagcagacccgtaagacggacctaggtaaagtatttttaggacttaagtttacttaacgtggttcaagtcgagccgtaagaccaaactcggtcctcgtcctacgtttcggggacgggaacgggaaccgaaagggtggaaanagtaacgaaaacgaacgtggtaggctcgaccaccatcctacgtttcctacc

SEQ ID NO: 340546 - DNA, 572 bp, Homo sapiens
  misc_feature: GZ8MTXP02IUL7X.3.31.C09.1.454.CMB.2.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (558)..(558): a, c, t, g, unknown or other
  misc_feature (558)..(558): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctccgaggggaaangccaccctctcctgcagggccagtcagagtgttagacaactacttagcctggtaaccaacagaaacctggccaggcctccaggctcctnatctatgatgcatccaanggccacgtggaccatcccagccctaggttcaggtcggcaggtgggtctggggacagcttcactcctacaccatcagcagccctagacgcctagaagttctttgacttagtttattacgtagtactagtacagtacgttacgactaacgtcggacccttcgtacgtaccgtttcggggacgggaacgggtaaccgaaaggggtcggaagaacgtaacgaaacgtacgtggtcgaacgtcgactacgnttcgtctacttacg

SEQ ID NO: 340547 - DNA, 571 bp, Homo sapiens
  misc_feature: GZ8MTXP02HRED6.3.31.C09.1.454.CMB.2.raw
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
  modified_base (329)..(329): a, c, t, g, unknown or other
  misc_feature (329)..(329): n is a, c, g, or t
  modified_base (392)..(392): a, c, t, g, unknown or other
  misc_feature (392)..(392): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaatggggttgacgcagtttccagccaccctgtctgtgtctccgagggganagagccaccctctcctgcagggccagtcagagtgttgacagcaacgttggcctggtaccagcagcaaccnggccaggcctccaggcctcctcatctatgatgacatccacgacggcccaccgtcncccagcctaggttcaggtcggactagggtgggtctaggggacaggtagttcacgtcctcaacntcagcagcctgcagtcaggtagttatttgacttagtttatttactgtctagtactaattaacaaagtacgtcggcctacggtcttcgtacggttcgggacgggacggtacgtaagggtacggaagacgtaaccgaaacgtaacgtggtacggacttacggacctacgtacttcgttacg

SEQ ID NO: 340548 - DNA, 708 bp, Homo sapiens
  misc_feature: GZ8MTXP02H9RRC.3.31.C09.1.454.CMB.2.raw
  modified_base (203)..(203): a, c, t, g, unknown or other
  misc_feature (203)..(203): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctccaggggaanagccaccctctcctgcagggccagtcagagtgttagcaactacttagccttggtacccaaacagaaacctggccaggcctcccaggcctcctcatctatgatgacatacccaaacaggggcccaacgtcgggccaacttccccaagccccaagggtttccaggtcgggccaaggttcggggtccgtaggggaccacggtcctttcgaacttcctccaaccctatacacgaccagcccgttaagacgtaccctagaaacgttactttttggaccttaagtttttacgttaacgttcggttacctaaggaccgtaaggtaccggttacggacctaaaaccggttccgggtcccttaccttaccgttaccggtttttaccgggggacggggtaaaccggggtaacccgtaaaagggggttacgggaaggtaaaaccgttaccgaaaaccggtaacgttcgggtacggaacgttacgaccgtaaccgtattcccgttgttcccttaccg

SEQ ID NO: 340549 - DNA, 622 bp, Homo sapiens
  misc_feature: GZ8MTXP02HUK8C.3.31.C09.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (381)..(381): a, c, t, g, unknown or other
  misc_feature (381)..(381): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctccngcagggccagtcagagtgtagcaactattagcctgaccaanagaacctggcagctccaggctctnatctatgatgcatcccaaacgacgggccaacgtggacactccccaggcctaggttcaggtcggctaggtgggtctgggacagcttcactctccacntcagcagtcctagacgcctagtaagttattttcgacgttaagttttattacgtcgttacacgtacaggtcgttaaggacctaacgttcggacccttcgtacgttaccggtttccggggacggggtaaacggggtaacccggtaaaggggtacggaaacggtaaactaaccggaaaaccggtaccgtagggttacgccgttacggaaccctaccgtactttaccggttcgtttacctttccg

SEQ ID NO: 340550 - DNA, 681 bp, Homo sapiens
  misc_feature: GZ8MTXP02IZDSH.3.31.C09.1.454.CMB.2.raw
  modified_base (205)..(205): a, c, t, g, unknown or other
  misc_feature (205)..(205): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccaggtgaaagngcccaccctctcctgcgagggccagtcagagtgttagcaactacttagcctggtaccaacagaaacctggaccaggcctccaggcctcctcatctatgatcgacactccaaacgcgggaccacgtcggcactaccccgagccgtaggttcaggtcggactaggggtcgggtacgtaggggaactacgggtacctttacgaccttcctaccaaccgtataccgaacgccaacgtacccgtaaggacgtaccgtaagtaacgttagttttacgacttagtttacttacgttagtacgagtacgtacggtacgttaacgcctaacggtccggtacccttcgtaccgttaacggtttccgggggaccgggttaacggggtaaccgtagggggtacggaaacggtaaacgtaacccggtaaaacggtaacgttgggtaacggtacctacggaccctaactcggtttacgtaccgtttcccg

SEQ ID NO: 340551 - DNA, 575 bp, Homo sapiens
  misc_feature: GZ8MTXP02F4RIA.3.31.C09.1.454.CMB.2.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcaactacttagcctggtaacccaanagaaacctggccaggctcccaggctcctcatctatgatgcatccaanggccatggcatcccagccaggttcagtcggcagtgggtctgggacagcttcactctcaccatcagcagcctagacgcctagtaagtattttgactagttagtatttacgtgttacgtaggttcttagtaggtttacctccgtaccgttcggttctagtcgtttacggccgaacggggtaccgtaagggttggaacgtaacgtaacgaaaacgtaaacgttcggtaggtccgtacggacctaccacgttctacgttctttaccg

SEQ ID NO: 340552 - DNA, 557 bp, Homo sapiens
  misc_feature: GZ8MTXP02ID21G.3.31.C09.1.454.CMB.2.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgctccaggggaanagccaccctntcctgcagggccagtcagagtgttagcaactacttagcctggtaaccaacagaaacctggccaggctcccaggctcctcatctatgatgcatccaaanaggccaagtggacactcccagccaggttcagtggcaggtggtcngggacaggcttcaactctacacccancanacacgactagacgactagtaagtatttagtagtagtttattacgttagtacgagacgtagtacgtacgacgacgtacgtctctctacgttcggacggacggtacgtaaggtaggacgaacgtaacgaaacgtaacgtacgtacgtcgtacgacctactactactcgttactac

SEQ ID NO: 340553 - DNA, 606 bp, Homo sapiens
  misc_feature: GZ8MTXP02GIG8W.3.31.C09.1.454.CMB.2.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
  modified_base (418)..(418): a, c, t, g, unknown or other
  misc_feature (418)..(418): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcaactacttagcctggtaccaacagaaacctggccaggcctcccgaggctccncatctatgatgacatacccaacgagggcccacgtcggaccacgtccccagcctaggttccaggtcggcaggttgggtctgggacagtctcactctcacatcagcagcctagacgctagaagttntttgcttaagtttatacgtgtcagtctagtcgtacgacctaacgtcgtaccttcgttacgtaccggtttcggggacgggtacgggtaaccgtagggggttaggacgtaacgtaacgtaaaacggtaccgttgggtacggtccgtacggacctaaaccgttcttaccgttacggtttacctttaacccg

SEQ ID NO: 340554 - DNA, 690 bp, Homo sapiens
  misc_feature: GZ8MTXP02IMSHM.3.31.C09.1.454.CMB.2.raw
  modified_base (206)..(206): a, c, t, g, unknown or other
  misc_feature (206)..(206): n is a, c, g, or t
  modified_base (264)..(264): a, c, t, g, unknown or other
  misc_feature (264)..(264): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcaactacttagcctggtaccaanagaaacctggccaggctcccaggctcctcatctatgatgcatcccaaacgacgggccacgtcggaccactccccagcctaggttccaggtcggcgtaggtggggtcgtaggggaccacggtacctttccgacttcctccaaccctatccagccaacgtccctagacgtcccgtaggtaaattcgtttttacggactttaaggtttttaactttacgttaggttaccgaacggtacgtacgggtaccgttaagggaccctaaacggttccggtcccctttacgttaccgttacccggtttttaccgggggaccggggaacgggggtaaacccgtaaagggggtcgggtaaacgtaaacgtaaccggtaaaaccggtaacgtcggtacggtcgtacgacccgtaccgtatccgttacgtactttaccg

SEQ ID NO: 340555 - DNA, 544 bp, Homo sapiens
  misc_feature: GZ8MTXP02J3I25.3.31.C09.1.454.CMB.2.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagtcttgtctccgaggggaaangccacctctcctgcagggccagtcagagtgttagcaactacttagcctggtaccaacagaacctggccaggctccaggctctcatctatgatgcatccaanaggggccacgtggaccatcccgagccaggttcaggtggcaggtgggtctgggacaggtcctcactcncaccatcagcagcctagacgtctagatnttttcgacttagtttactacgtgtcagtcagcgtagccaacgtcggtaccctacgtctaccgtttcgggacggtacgggaccgaaggtcggacgatacgaaaacgtacgtggtacggctacgaccgactagtctacgtactcg

SEQ ID NO: 340556 - DNA, 566 bp, Homo sapiens
  misc_feature: GZ8MTXP02I3RD6.3.31.C09.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
  modified_base (421)..(421): a, c, t, g, unknown or other
  misc_feature (421)..(421): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccagggaaangccaccctntcctgcagggccagtcagagtgttagcaactacttagcctggtaccaacagaaacctgccaggctccaggctccncatctatgatgcatccaanagggcccacgtggcactcccagccaggttcagtcggcaggtcggtctgggacagcttcactcncaccatcagcagcctagacgcctgaagtactttgcttaagtttattacgtntacagctagcgtagacctaacgtcggccctcgtccgtacgtttcgggacggtacgggtaccgagggttagggaacgtagtaaccgaaaacgtaacgtggttacggcgttacgaccgtaccctagttccgttacgttccctttacg

SEQ ID NO: 340557 - DNA, 639 bp, Homo sapiens
  misc_feature: GZ8MTXP02FG44E.3.31.C09.1.454.CMB.2.raw
  modified_base (204)..(204): a, c, t, g, unknown or other
  misc_feature (204)..(204): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtcttgtctccgagggaaanagccaccctctcctgcagggccagtcagagtgttagcaactacttagcctaggtaccaacaagaaacctggacccaggcctccccagggcctccctcatctatgatcgacactacccgaacgacgggcccaacgtggaccactccccgagcccgtaggttccgaggttcgggcctaggtggggtcgtggggacagtcctcgacttctaccaccatcagcacgtcctagactcgtagagtatttgacttagtttattacgtgtacagcgtagacgtaacgactaacgtcggaccttctccgtacggtttccgggcggggtaaacgggtaaccgtaaggggtaggaacgtaaacggtaaccgtaaaaacggaccgttaggtacggtaaccgtacggtaccctaaccgtacgtttaccgttacggttacctttacccg

SEQ ID NO: 340558 - DNA, 532 bp, Homo sapiens
  misc_feature: GZ8MTXP02IJNYK.3.31.C09.1.454.CMB.2.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccgaggggaangccacctctcctgcagggccagtcagagtgttagcaactacttagcctggtaccaanagaaacctggaccaggcctccgagctcctcatcatgatgacatccaacgnggccagtggcactccagcctaggtcagtcgcagtggtcgtggacagtcttnactctacacctatcagcagcctagacnctagatatttnacttagttatcgtgtacagctagctagacctaagtcgaccttcgtacgtacgttcgggacgggtaacggaccgtaagggtaggactaacgtacgaaacgtacgtgtgaactgactacattcgtagttactac

SEQ ID NO: 340559 - DNA, 629 bp, Homo sapiens
  misc_feature: GZ8MTXP02F8HS9.3.31.C09.1.454.CMB.2.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcaactcttagcctggtaccaanagaaacctggccaggctacccaggcctcctnatctatgatgcataccaacacgggccaacgtggcactcccgaagccgaggtttccaggtcggtccaggtggggtcgtaggggacctagtaccttcaactcctaccaccatcaagcaaggccctagacgcctagaacgtatttttagacttagttttaacttacctggttacaggacagtaccgttaaggccaaaccgttcggacccttccttacgaaccgttttcggggcgggtaaacggggaaccctaaaggggttggaagtaacgttaacaaaaccggtaaccgtggttcggaacttcggaccaaacccgttattaccgttcgttacttaccg

SEQ ID NO: 340560 - DNA, 533 bp, Homo sapiens
  misc_feature: GZ8MTXP02F12C2.3.31.C09.1.454.CMB.2.raw
  modified_base (205)..(205): a, c, t, g, unknown or other
  misc_feature (205)..(205): n is a, c, g, or t
  modified_base (417)..(417): a, c, t, g, unknown or other
  misc_feature (417)..(417): n is a, c, g, or t
tcagagacgcactccacgaccggtgctcgatttagacgtctcatcaaggaaggaaggggggaggaactgctcagttaggacccagagggaaccatggaagccccagctcagcttctcttcctcctgctactctggctcccagataccacggagaaattgtgttgacacagtctccagccaccctgtctttgtctccaggggaaangccaccctctcctgcagggccagtcagagtgttagcaaactacttagcctggtaccaacagaaacctggaccaggctcccaggctcctcatctatgatgcatccaacagggccactggcatcccagccaggttcagtcgcagtggtctgggacagctcactctcaccatcagcagcctagagcctagaagtattttgctagtttatactgtnagtcagcgtagacaactggccctatcacgtttcgggcggagggaaccgaagggtggaagaaactacgaaaacgtaacgtggtacggctacggactaaccgatcgttcgtactttac

SEQ ID NO: 340561 - DNA, 727 bp, Homo sapiens
  misc_feature: GZ8MTXP02JBA8T.3.31.C09.1.454.CMB.2.raw
  modified_base (205)..(205): a, c, t, g, unknown or other
  misc_feature (205)..(205): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgtctccgaggggaaancgccaccctctcctgcagggccagtcagagtgttagcaactacttagcctaggtaaccaagacgaaacctggaccaggcctccgaggcctcctcactctatgatgcatacccaaacgacgggcctaacgtcggaccactaccccgacggaccgtacggttcgaggtccggtacgtaggggtcggggtacgtacggggaacgtacgtacttccacgttctaccacctactacgacgtacgacgtacccgtaggacgtaccgtaggtaaaactttcgttttacgacgtttaaacggttttacttaacggttactacgtaaccgtacggtaacgtacggttaacgacctaaaccgggttccggacctttccgtaccgttaccgggtttaccggggaaccgggggtaaccgggtaaacggtaacgggggtacggtaaacggtaaacgtaaaccggtaaaacggtaacgttcgggtaacggtaaccgtacgacctaacgtgtttcccgttacgtttaccttaacccg

SEQ ID NO: 340562 - DNA, 601 bp, Homo sapiens
  misc_feature: GZ8MTXP02GBB33.3.31.C09.1.454.CMB.2.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaaccaacagaaacctggcaggctccaggctccnatctatgatgcatccaaacnggccactggcactcccagcaggttcagtggcaggtgggtctgggacagtcttcacgtctaccacatcagacacgaccctagacgtcctagtaaagtacttttaggccttaaaggttttacttacgttagttaccaggtactaggtaccgttaggacccaaacgttcgggcccttcttacgtaccgttccggggtacggggaacgggtacccgtaagggtcggtaagaaacgttacgaaaaccgtaagtcgtaaggccgttgaccgtacctattacgttcggtctttaccg

SEQ ID NO: 340563 - DNA, 554 bp, Homo sapiens
  misc_feature: GZ8MTXP02JB5M2.3.31.C09.1.454.CMB.2.raw
  modified_base (205)..(205): a, c, t, g, unknown or other
  misc_feature (205)..(205): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtcttgtctccgaggggaaangccaccctctcctgcagggccagtcagagtgtagcaactcttagctggtaccaacagaaacctggaccaggctcccaggctcctcatctatgatgcatccaacagggccagtggccatcccagcctaggtcagtcggctaggtggtcngggacaggtcttcactctacacatcancagcctagcgcctaggtaatacttttgacttagttattactgtactagctagacgtagacgaacttcggaccttcgtactacggttcggacgggacgggtaaccaggggtacggaacgaataccgaaacgtaacgttgacgggtcacggtaccacgtatttcgtcgttcttacg

SEQ ID NO: 340564 - DNA, 617 bp, Homo sapiens
  misc_feature: GZ8MTXP02GD7JF.3.31.C09.1.454.CMB.2.raw
  modified_base (205)..(205): a, c, t, g, unknown or other
  misc_feature (205)..(205): n is a, c, g, or t
  modified_base (270)..(270): a, c, t, g, unknown or other
  misc_feature (270)..(270): n is a, c, g, or t
  modified_base (464)..(464): a, c, t, g, unknown or other
  misc_feature (464)..(464): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaancgccaccctctcctgcagggccagtcagagtgttagctaactacttagccttaggtaacccaaanaacgaaaacctggacccaaggcctccccgaggcctcctcattcctaatgatgcaatacccaaagcgggcctacgtcggacctactcccaggtccaaggttccaggtccggactagggtcgggttactggggaaccacggtacttccaacttccgtaccgaccctaatcccgaggaccaacgcccgtaaggaacnccttagaaagtacttttgactagtttatactgtacagaccagtacgtagacctaacgcgtcctacttcgacgttcgggcgtaaacgggacctaaggtcgaagacttacgaaaacgtacgtggacgtaactcgacaacctgtactcgtacttcg

SEQ ID NO: 340565 - DNA, 536 bp, Homo sapiens
  misc_feature: GZ8MTXP02FG314.3.31.C09.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (263)..(263): a, c, t, g, unknown or other
  misc_feature (263)..(263): n is a, c, g, or t
  modified_base (373)..(373): a, c, t, g, unknown or other
  misc_feature (373)..(373): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaaggggaaangccaccctcncctgcagggccagtcagagtgttagcaactcttagcctggtaccaanagaaacctggccaggctccaggcctcctcatctatgatgcatccaaacagggccactggcacgtcccagccaggttccagtcggcagtgggtctgggacaggctcactcncacatccagcaagcctagagcctagaagtatttgacttagtttatactgtcagctagacgtagcaaacgtgcctctacacgtttcgggacggaacggaccaagggtgaaacgtactacgaaaacgtactggtacggaacgtggactaccgatctacgtcttac

SEQ ID NO: 340566 - DNA, 648 bp, Homo sapiens
  misc_feature: GZ8MTXP02H0PDW.3.31.C09.1.454.CMB.2.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (443)..(443): a, c, t, g, unknown or other
  misc_feature (443)..(443): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacctgtctttgctccgaggggaaangccaccctctcctgcagggccagtcaagtgtgttagctaaactacttagccttggaaccaacaagaaacctggccaggcctcccgaggcctcctnatctaatgactgcactccaaagagggtccacgtggacactccccgagtcccgaaggttcaaggtggacgtaggtggggtctaggggacctaggtcctttcaacttccacaacctagacacgcagcctagacgctagaaagtttntttgacttagtttatacgtagtcaaggtctagtacgtacgacgtaacgttcggtacccttacgttccgttaaccggttcggggaaccgggggtaaccggtaaaccggtaaggggtaggaaaccgtaaaggtaaaccgaaaacgggtaccgttaggtacggtaacctacggaccgtaccgtacgttccgtttaacggttccttacg

SEQ ID NO: 340567 - DNA, 674 bp, Homo sapiens
  misc_feature: GZ8MTXP02GYFCH.3.31.C09.1.454.CMB.2.raw
  modified_base (198)..(198): a, c, t, g, unknown or other
  misc_feature (198)..(198): n is a, c, g, or t
  modified_base (644)..(644): a, c, t, g, unknown or other
  misc_feature (644)..(644): n is a, c, g, or t
tcagagacgcactccacgaccggtgctcgatttagacgtctcatcaaggaaggaagggggaggaactgctcagttaggacccagagggaaccatggaagccccagctcagcttctcttcctcctgctactctggctccagataccaccggagaaattgtgttgacacagtctcagccacctgtcttgctcgagggaancgccacctctcctgcagggccagtcgagagtgttagctaactacgttacgccttagggtaaccaacgaaggaaacccgtggggacccaagggcccttccccgagggtacccttacccttacactttaccagttaggacttgacctaacgtacccgaaacggaacgggcccctaacgttcggaaccctaacgttaccccgaaggccttaaggggtcctaacggttgggaccttaggggtcgggtaccgtaggggaacctaggtacctttccaacttcgtaccactaatcacgcaacggtcctaggacgtcctaggaattacgtttggacttaatttagtacttaggtacagtagacgtaggtacgaaccgtaacgtggacccttgtcttaaccggttcgggacggtacgggaaccgaaggtcgggaaacacgtaaacgaacgtacgngtacgaactacactactctcgtactctacg

SEQ ID NO: 340568 - DNA, 306 bp, Homo sapiens
  misc_feature: GZ8MTXP01B3QDA.11.59.F04.1.454.CMB.2.raw
  modified_base (303)..(306): a, c, t, g, unknown or other
  misc_feature (303)..(306): n is a, c, g, or t
tcagcgagagataccacgaccggtgctcgatttagtacacacacttagggattgggcagcctgacatctgaggacacggccatatattactgtgcaatcagttataggacgtcgtccgagggctactttgactcttggggccagggaaccctggtcaccgtctcctcagcctccaccaagggcccatcggtcttcccctggcgccctgctccaggagcacctccgagagcacagcggccctgggctgcctggtcaaggactacttccgtatctctcgctgagcgggctggcaaggcgcatagnnnn

SEQ ID NO: 340569 - DNA, 507 bp, Homo sapiens
  misc_feature: GZ8MTXP01B77I7.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccggtctcctgggcagtcagtcaccatcccctgcactggaaccagcaatgatgttggtcttataagtatgtctcatggtacgcagaacccaggcaaacgcccccaagtcgtctctatgatgtcactaagcgcctcagagtccctgactcgattctctggctccaagtctggcacacgcctcctgaacatctctgggctccgaggctgagatgagctgatttattagtgctgctcattagtggtaataccttacttcttttctcgtttcggaaacttgggaccctcggttcaccgttccgtaagtcaacgcccaggcccaacccgctcg

SEQ ID NO: 340570 - DNA, 515 bp, Homo sapiens
  misc_feature: GZ8MTXP01EB813.11.59.F04.1.454.CMB.2.raw
  modified_base (320)..(320): a, c, t, g, unknown or other
  misc_feature (320)..(320): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagcggcctnaggagtcctgactcgattctctggttcccttgtctgacacctcacgcctcctgccatcactggctccagcctgagatgagctgattattactgtcagtccttgactattaaactggtatgtggtaattcgggcggtacgggaccacggtaaccgttcgttggttcaaggccaaggctcgcccctcggttctaacc

SEQ ID NO: 340571 - DNA, 629 bp, Homo sapiens
  misc_feature: GZ8MTXP01EIOYO.11.59.F04.1.454.CMB.2.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (247)..(249): a, c, t, g, unknown or other
  misc_feature (247)..(249): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttngtgtatatatntnnngtacgacacgaaccgacgacaacgaccccacgtacgtctctatgtatagtacgactaacgacgccgtacgtacgtacgtccccgtcgtagtacgtactctactcgtcgtaccgtacgtacgtacgtacgaaccgaccgacccgtaccctacgacactctcgtcggtcgtcacgacgtcgtagagtagtagtacggtagtagttattagttacgtcgtcgtacgtactacgtaacgtacgtaacgttaaccgttaacctttaccgttttaccgtttaccgtttaccggttaaccggtaacggttaccggttacccggttacccggtaacccgtacccgtaaccggtaccgtaccgacccgtaacccgaacccgtaaccccg

SEQ ID NO: 340572 - DNA, 539 bp, Homo sapiens
  misc_feature: GZ8MTXP01CKKFL.11.59.F04.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgtggtcgttataagtatgtctcatggtaccggcagaacccaggcaaacgccccccaagtcgttctctangatgtcactaagcgcctnaggagtccctgatcgattctctggctccaagtctggcaacaccggcccctccctgaacatctctgggctccagggctggagatgaggctgtattattattgctgtctactatataggaaacgttaccttaacttcttttctcgtttcgaacgtcggaccacggtcaaccgtctaggtcacgcccaacggcccaacccgtacttcgtactacttccgttcgttccccgccctcctcgtactcttctcgctcgg

SEQ ID NO: 340573 - DNA, 512 bp, Homo sapiens
  misc_feature: GZ8MTXP01AT9P2.11.59.F04.1.454.CMB.2.raw
  modified_base (321)..(321): a, c, t, g, unknown or other
  misc_feature (321)..(321): n is a, c, g, or t
  modified_base (475)..(475): a, c, t, g, unknown or other
  misc_feature (475)..(475): n is a, c, g, or t
  modified_base (508)..(508): a, c, t, g, unknown or other
  misc_feature (508)..(508): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaaatgatgttggtcttataagtatgtctcatggtaccggcagaacccaggccaaacgcccccaagtcgttctctatgatgtcactaagcggcctnaggagtccctgactcgattctctggactccaagtctggcaacacggcctcctagacatctctgggctcaggctgacgatgaggctgattattattgctgctcattagtgtaacgtacctacttctttctcttcggaacttgggacctcggttcnccgttctaagggtcaacgcccaggcccaacccncgtc

SEQ ID NO: 340574 - DNA, 504 bp, Homo sapiens
  misc_feature: GZ8MTXP01ALJEK.11.59.F04.1.454.CMB.2.raw
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgtctctatgatgtcactaagcggcctcaggagtccctgactcgattctctggctccaagtctgggcacacggcctcctgacatctctgggctccaggctgaggatgagctgattntattgctgctcatatggtaatacctacttcttttcncttggaacttgggacctcggttcnccgttctaaggtcaagcccaaggcccaacccncgtcg

SEQ ID NO: 340575 - DNA, 547 bp, Homo sapiens
  misc_feature: GZ8MTXP01DEGCH.11.59.F04.1.454.CMB.2.raw
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcagccccgctcagtgtccggtctcctgggcagtcagtcacatcccctgcactggaaccagcaatgatgttggtcgttataagtatgtctcatggtaccggcagaacccaggcaaacgcccccaagtcgtctctatgatgtcactaagcgcctnaggactccctgactcgattctctggctcaagtctgacacacgcctccngaacntctcgtggctccgagctgagatgagctgattattattgctgctcgattagtggtaaacgttacctacttcttttaacctcgtttacggaaaccttgggaaccctcgggttccttacccggttacctaacggggttaccaacggtccccaaaacgggcccctaaaacccccttgttcccg

SEQ ID NO: 340576 - DNA, 529 bp, Homo sapiens
  misc_feature: GZ8MTXP01A5NZR.11.59.F04.1.454.CMB.2.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (349)..(349): a, c, t, g, unknown or other
  misc_feature (349)..(349): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggnagaacccaggccaaacgcccccaagtcgttctctangatgtcactaagcggccctcaggagtcccctgatcgattctctggctccaagtctggcaacaccggcccctcctgaacntctctgggctcaggctgaggatgaggctgattatatgctgctcatagtgaacgttacctacttcttttctcgttcggaacgttgggaacctcggtcaccgttctaggtcacgcccgaaaggcccaaacccgtcttgcctacttcgttcgttccccgcctcctcgactcttctcgctcggg

SEQ ID NO: 340577 - DNA, 570 bp, Homo sapiens
  misc_feature: GZ8MTXP01D4DWN.11.59.F04.1.454.CMB.2.raw
  modified_base (459)..(459): a, c, t, g, unknown or other
  misc_feature (459)..(459): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccatcccctgcactggaaccagcaatgatgttggtcgttataagtatgtctcagtggtaccggcaacgaacccaggccaaacgcccccaagtcgttctctatgatgtcacgtaacgccggcctcgaggacgtccctgactcgattctctggcctaccaaggtctagggaccaacgaccggccctccctagaactatctcgtgggcctccgaggctagaggatgaaggcttgtaatttagttagttggtatcctanattagtacggtaattacccttacttccttttctaacgttacggaacttcgggacctacgggtcacccgttcttacggtcacgccccaaggcccaaaccctcgttctaaccc

SEQ ID NO: 340578 - DNA, 509 bp, Homo sapiens
  misc_feature: GZ8MTXP01ECLOJ.11.59.F04.1.454.CMB.2.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtctataagtatgtctcatggtaccgnagaacccaggcaaacgcccccaagtcgtctctatgatgtcactaagcgccctnaggatccctgatcgattctctggctccaagtctggcaacacgcccctcctgaacatctctgggctccagctgagatgaggctgattatattgcttgcttcatanaggtaataccttacttcttttactctttacgggaacttggggacctcggtcaaccgttcctaggtcagcccaaggccaaacccnttgcncttcttgttcccnctcnctacncttctcgctg

SEQ ID NO: 340579 - DNA, 548 bp, Homo sapiens
  misc_feature: GZ8MTXP01DYV0S.11.59.F04.1.454.CMB.2.raw
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtcccgggtctcctgggcagtcagtcaccatcccctgcactggaaccagcaatgatgttggtcgttataagtatgtctcagtggtaccggcaacgaacccaggaccaaacgccccccaagtccgttctctatgatgtacactaagccggccctcgaggacgtccctgactcgattctctggcctcgaagtctggaccaacnccggcctcctgaacatcnctggctcgagctgagatgagctgtattatattgctgctcattagtcggtaaacttccttacttcttttctcgttcgggaacttcgggacctacgggttccaccgttccgtaacgggtcaaccgacccaacggttccccaaccccgcgttccg

SEQ ID NO: 340580 - DNA, 536 bp, Homo sapiens
  misc_feature: GZ8MTXP01BRFQH.11.59.F04.1.454.CMB.2.raw
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtacggcagaacccaggcaaacgcccccaagtcgttctctatgatgtcactaagcgcctnaggatccctgactcgattctctggctccaagtctggcaacaccggccctcctgaactatctcgtgggcctcgaggctggagatgaggctgatttattagtgntgctnatagtgtaagttacctacttctttctccgttcgggtaaacttcgggaacctacgggttccaccgttcgtaacgggtcaacgccccgaacggcccctaaacccttcgttccg

SEQ ID NO: 340581 - DNA, 542 bp, Homo sapiens
  misc_feature: GZ8MTXP01CMI41.11.59.F04.1.454.CMB.2.raw
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcacgaacccaggacaaacgccccccaagtcgttctctatgatgtcactaagcgcctnagatccctgactcgattctctggcttccaagtctcgggcaaacnccggccctcctgaacatctctgggctccgaggctgagatcgaggctgattattatgctgctgtatatggtaactacctacttcttttctcgttcgggtaaacttcgggtaccctaaggttccttaccggttccgtaaggtccaacggcccctaaggcccctaacccttaacgttccg

SEQ ID NO: 340582 - DNA, 757 bp, Homo sapiens
  misc_feature: GZ8MTXP01EBK6J.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatccctgcactggaaccagcaatgatgttggtcttataagtatgtctcagtggtaccggcaacgaacccaggacaaacgcccccaagtcgttctctatgatgtacactaacgcgcctgaggactcctgactcgattctctcggacctaccaagtctcgggaccaaaccgaccggtccctaccctagaaacctattcctcgtcgggccttccgaacgggtcgttaggaagggtacttagggaacgggtccttaagggttaacttttaaagttttaagtttcggtacccttagggtccctttaacgtaaatttaaggttaacggggtaaaacccgttttaccccttttaaacccgttttccctttttttaacccggttaacccggtttttaaccccggggtaaaaccgtttaccggggggtaaacccccgttaacccgggggtttaccccgttaaaccccgggtttaccccgtttaaacgggggtaccctaacccgggtaacccccgtaaacccggggacccccctaaaacccccgttaacggtttaaccccg

SEQ ID NO: 340583 - DNA, 531 bp, Homo sapiens
  misc_feature: GZ8MTXP01EWEED.11.59.F04.1.454.CMB.2.raw
  modified_base (322)..(322): a, c, t, g, unknown or other
  misc_feature (322)..(322): n is a, c, g, or t
  modified_base (427)..(427): a, c, t, g, unknown or other
  misc_feature (427)..(427): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggacaaacgccccccaagtcgttctctatgatgtcactaagcggccctnaggacgtccctgactcgattctctggctccaagtctggcaacacggcctccctagacatctctgggctcgaggctgaggatgaggctgaattattattgctgctnatatggtaattaccttacttctttctcgttcggaaacttcgggaacctacggttccgaccgttcctaagggtcaacgccccaaggccctaacccgttaactccg

SEQ ID NO: 340584 - DNA, 599 bp, Homo sapiens
  misc_feature: GZ8MTXP01CEK0M.11.59.F04.1.454.CMB.2.raw
  modified_base (173)..(173): a, c, t, g, unknown or other
  misc_feature (173)..(173): n is a, c, g, or t
  modified_base (445)..(445): a, c, t, g, unknown or other
  misc_feature (445)..(445): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgntcagtgtccgggtctcctgggcagtcagtcaccatccctgcactggaaccagcaatgattgttggtcttataagtatgtctcatggtaccgcaacgaacccaggccaaacgcccccaagtcgttctctatgtatgtcaacgtaacgccggcctgaggacgtccctgacctcgattctctggtactacccaagtcctagggaccaaccgaccggcccctacctagaactctccgtcgtcgggctacccgagggtcctaggacgagtgacggtntagtatttattgtgctgtctataagttacgtacgtaacttaccttctttctttcgtacgttaccggtaacggttccggtaccgtacggttccgttccgttaccgtaacggtaccctaaccgaccccgtaaccggcccctaaacccgttcgtccg

SEQ ID NO: 340585 - DNA, 518 bp, Homo sapiens
  misc_feature: GZ8MTXP01DW8QB.11.59.F04.1.454.CMB.2.raw
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
  modified_base (435)..(435): a, c, t, g, unknown or other
  misc_feature (435)..(435): n is a, c, g, or t
  modified_base (496)..(496): a, c, t, g, unknown or other
  misc_feature (496)..(496): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgnagaacccaggccaaaacgccccccaaagtcgttctctatgatgtcaactaagcggccctnaggagtcccctgatcgattctctggctccaagtctggcaacncggcccctcctgaacatctctgggctccaggctgagatgaggctgattatattgctgctcatatggaatacctacttcttttctcttcgaactgggaccncggtcaccgtctaggtcacgcccaaggccaaacccgtcttgcctacttcttcgttcccccncctctcgtctccttctcgcgtg

SEQ ID NO: 340586 - DNA, 519 bp, Homo sapiens
  misc_feature: GZ8MTXP01CEZKF.11.59.F04.1.454.CMB.2.raw
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccgcagaacccaggcaaacgccccccaagtcgttctctatgatgtcactaagcggcctcagacgtccctgactcgattctctggcctccaagtctggcaacacggcctcctgaacatctcgtgggcctccgaggctgaggatgaggtctgatttattattgctgctcatatggtaattcctacttcttttcncgtttcggaaccttgggtaccncggttcncccgttctaaggtcaacgcccaagcccaacccgntccg

SEQ ID NO: 340587 - DNA, 531 bp, Homo sapiens
  misc_feature: GZ8MTXP01AGSO5.11.59.F04.1.454.CMB.2.raw
  modified_base (320)..(320): a, c, t, g, unknown or other
  misc_feature (320)..(320): n is a, c, g, or t
  modified_base (487)..(487): a, c, t, g, unknown or other
  misc_feature (487)..(487): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaacgcccccaagtcgttctctatgatgtcactaagccggccctnaggagtccctgactcgattctctggctccaagtctggcaacacggcctccctagacatctctgggctcgaggctggaggatgaggctgatttattattgctgctcattagtggtaacgtaccttacttcttttctcgtttcggaacttcgggaccctacgggttccnccgttcctaaggtccaacgccccaaggcccctaacccgcgttcg

SEQ ID NO: 340588 - DNA, 538 bp, Homo sapiens
  misc_feature: GZ8MTXP01DU7TH.11.59.F04.1.454.CMB.2.raw
  modified_base (431)..(431): a, c, t, g, unknown or other
  misc_feature (431)..(431): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggacaaacgcccccaagtcgtctctatgatgtcactaagcggcctgaggacgtcctgactcgattctctggctccaagtctggaccaacgaccggcctccctagaacatctcgtgggcttccgaggctaggaggatgagctgatttattatgctgctnatagtggtaacttcctacttcttttctcgttacggaacttgggtaccctcggttccaccggttccgtaaggtccaacggccccaacggcccctaaaccccgcttccg

SEQ ID NO: 340589 - DNA, 606 bp, Homo sapiens
  misc_feature: GZ8MTXP01D3YOA.11.59.F04.1.454.CMB.2.raw
  modified_base (140)..(140): a, c, t, g, unknown or other
  misc_feature (140)..(140): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (575)..(575): a, c, t, g, unknown or other
  misc_feature (575)..(575): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcttataagtntgtctnatggtaccgnaagaacccaggaccaaacgcccccaagtcgttctctangatgtcactaacgcgccctgaggatccctgatcgattctctggctcaagtctcggacaacgaccggcccctacccgtagaacctacttcctaaccgtcgggcctccgaagggtcctaggaggagtgagtctagtaatttatattgcttgcttacaagttagtacgggtaaacttaccctttacttctttttacgtaccgtttacggaaacgttcggggaaccctacgggtcctaaccgttctacggtcacggaccccaacggacccaaacccgtcttcgtacctaccgttccttcggttcccccnccttcctaacgttctccttcgtcgcgttcgg

SEQ ID NO: 340590 - DNA, 514 bp, Homo sapiens
  misc_feature: GZ8MTXP01AGGWE.11.59.F04.1.454.CMB.2.raw
  modified_base (509)..(509): a, c, t, g, unknown or other
  misc_feature (509)..(509): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaacgccccccaagtcgttctctatgatgtcactaagcggccctcaggagtccctgactcgattctctggcctcaagtctcggcaacacggcctccctgaacatctctgggctcaggctgagatgagctagattattattgctgctcatatgtaagtacctacttcttttctcttcggaaacttcgggacctacggttcaccgttctaaggtcaacgccacggcctaacccgngtccg

SEQ ID NO: 340591 - DNA, 530 bp, Homo sapiens
  misc_feature: GZ8MTXP01E0KSS.11.59.F04.1.454.CMB.2.raw
  modified_base (319)..(319): a, c, t, g, unknown or other
  misc_feature (319)..(319): n is a, c, g, or t
  modified_base (492)..(492): a, c, t, g, unknown or other
  misc_feature (492)..(492): n is a, c, g, or t
  modified_base (526)..(526): a, c, t, g, unknown or other
  misc_feature (526)..(526): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcgttataagtatgtctcatggtaccgcagaacccaggcaaacgcccccaagtcgttctctatgatgtcactaagcggccctnaggagtccctgactcgattctctggctccaagtctggcacaccggtcctcctagaacatctcgtcgggctccgaggctaggacggatgaggtctagtagtttattagttgctgctcatagtaggtaacttacctacttctttctcttacgggacttcggggacctacggttcnccgttcctaaggtcaacgcccagccctaacccgntccg

SEQ ID NO: 340592 - DNA, 565 bp, Homo sapiens
  misc_feature: GZ8MTXP01D2HN8.11.59.F04.1.454.CMB.2.raw
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (439)..(439): a, c, t, g, unknown or other
  misc_feature (439)..(439): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggacaaacgcccccaagtcgttctctatgatgtcactaacgccggccctnacggacgtccctgactcgattctctggcctaccaagtctggaccaacaccggccctccctagaacntctcgngggcctccgaggctgagatgaggtctgtattattatgctgctnattacgtggtaacttaccttacttcttttctcgttacgggaacttcggggaaccctacgggttcccttaccggttccgtaagggtccaacggccccgaacggacccctaaaccccgttcttaaccg

SEQ ID NO: 340593 - DNA, 623 bp, Homo sapiens
  misc_feature: GZ8MTXP01EMDBC.11.59.F04.1.454.CMB.2.raw
  modified_base (141)..(141): a, c, t, g, unknown or other
  misc_feature (141)..(141): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccatcccctgcactggaaccngcaatgatgttggtcttataagtntgtctcatggtaccgnagaacccaggaccaaacgcccccaagtcgtctctangatgtcactagcgcctgaggactcccngatcgattctctggcctactaagtctggacaacgaccggtcccctacctagaacctatcctcgtgggctcgaggctggagatgaggtctagtattattagttgctgactacagtagtcggtaaactttacccgttactttcggttttacctcggtttaccggaacgttcggggaaccctacgggttacctaacccggttcctaagggtcccaaccggccccgaaaggtacccccttaaaccccgcgtttacccgtacctaaccttcccgttcccgttcccccgtcccttccgttaacgttaccttccgttccttccggttcgtcggg

SEQ ID NO: 340594 - DNA, 515 bp, Homo sapiens
  misc_feature: GZ8MTXP01BTI9N.11.59.F04.1.454.CMB.2.raw
  modified_base (319)..(319): a, c, t, g, unknown or other
  misc_feature (319)..(319): n is a, c, g, or t
  modified_base (410)..(410): a, c, t, g, unknown or other
  misc_feature (410)..(410): n is a, c, g, or t
  modified_base (508)..(508): a, c, t, g, unknown or other
  misc_feature (508)..(508): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtcttataagtatgtctcatggtacgcagaacccaggcaaacgcccccaagtcgttctctatgatgtcactaagcggccctnaggatccctgactcgatctctggctccaagtctgggcaacacggcctcctgaacatctctgggctcaggctgagatgagctgattattatnctgctcatatggtaataccttcttctttctcgttcggaacttgggtaccacggttccaccgttcctaagggtccaacgtcccgaaggcccctaacccncgttccg

SEQ ID NO: 340595 - DNA, 536 bp, Homo sapiens
  misc_feature: GZ8MTXP01DZ759.11.59.F04.1.454.CMB.2.raw
  modified_base (326)..(326): a, c, t, g, unknown or other
  misc_feature (326)..(326): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcacgaacccaggaccaaacgccccccaagtccgttctctatgatgtcactaagcggccctnacggtactcctgactcgattctctggacctcaagtctggacaacgacggcctcctagaacatctcgtcgggctcgaggctgacggntgngctgtatttattattgctgctcgataatcggtaattacctacttctttctcttcggaacgttcggactacggttcgttccgttctaaggtccaacgcccacggaccctaacccgttcgtcc

SEQ ID NO: 340596 - DNA, 634 bp, Homo sapiens
  misc_feature: GZ8MTXP01C168Q.11.59.F04.1.454.CMB.2.raw
  modified_base (140)..(140): a, c, t, g, unknown or other
  misc_feature (140)..(140): n is a, c, g, or t
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttaataagtatgtctcagtggtaccgnagaacccaggcaaacgcccccaagtcgtcnctangatgtcactaagccgccctgaggactccctgatcgattctctggctaccgaagtctggaccaacgccggtccccctcctagaacctatcctcgtcgggcctccgaggtctggaaggactgaggcttagtattattattgctgtctacattaagtggtaaacgttaccttactttctttttacgtcgtttacgggaacgtcgggtaaccctaccgggttcctaaccccggttcgtaaccgggtccaaccggacccctaaaccgggccccaaaccccgtacttccggtaccctaaccgttcccgttcccgttacccccctaaccccttcccttcgttacttcccttaccgttcccgttggaaccggg

SEQ ID NO: 340597 - DNA, 605 bp, Homo sapiens
  misc_feature: GZ8MTXP01EF2IV.11.59.F04.1.454.CMB.2.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtntgtctcagtggtaccgcaacgaacccaggaccaaacgccccccaagtcgttctctangatgtacaactaacggccggcccctagacggacgtccccgtagtcgtacttacttcgtcgtcgtaccctaacgtacgtacggtacgaaccaccggcccgtccccctacgaactaactctccgtcggccgtccgacggcgtcgaggagtagaggtcgtgtattattattgtcgtctacgtctagtagtacgtacgtacttaccttctttcgttcgtcgtaacgcgtaccgtaccgtcgtaccgtaccgtcgtacgaccgaccgaccggaacctacccactcgttctacctcttccttcccttaccctcctctctctcttcgtcgttgtcgg

SEQ ID NO: 340598 - DNA, 599 bp, Homo sapiens
  misc_feature: GZ8MTXP01EQNBF.11.59.F04.1.454.CMB.2.raw
  modified_base (400)..(400): a, c, t, g, unknown or other
  misc_feature (400)..(400): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccggtctccgtgggcagtcagtcaccatcccctgcactggaaccagcaatgatgttggtcttataagtatgtctcagtggtaccggcacgaacccaggaccaaacgcccccaagtcgttctctatgatgtcactaacgccgcctgacggacgtccctagactcgtattctctcggacctccaagtctgggaccaacgaccggtccctcctagaaacctnttcctcgtgggcctcgaaggtcgtaggacggatgggacggtacttaggtaacttttagtttagttgccttgcctagtaattagtacgggtaacttaccttactttcttttctcgttacgggaacttcgggaccctaacgggttccttccggttcctaagggtccaacggccccgaacggcccctaaccccgttgttccg

SEQ ID NO: 340599 - DNA, 566 bp, Homo sapiens
  misc_feature: GZ8MTXP01A55WZ.11.59.F04.1.454.CMB.2.raw
  modified_base (172)..(172): a, c, t, g, unknown or other
  misc_feature (172)..(172): n is a, c, g, or t
  modified_base (428)..(428): a, c, t, g, unknown or other
  misc_feature (428)..(428): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctccgtgggcagtcagtcaccatcccctgcactggaaccagcaatgatgttggtcttatagtatgtctcagtggtaccgcacgaacccaggaccaaacgcccccaagtcgtctctatgatgtcacgtaacgccggcctgacggacgtccctgactcgtattctcgtcggcctaccaagtctacgggaccaaccgcggcccctccctagaactctcgtcgtcgggctcccgaggctggacggangagtctagtatttagttatgctgctctatagtaggtaactaccttacttctttcgtcgttacggacgttcgggtacctacgggttccttccgttccgtaagggtccaacgtcccgaacggaccctaacccgttgtccg

SEQ ID NO: 340600 - DNA, 525 bp, Homo sapiens
  misc_feature: GZ8MTXP01DJA3K.11.59.F04.1.454.CMB.2.raw
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (399)..(399): a, c, t, g, unknown or other
  misc_feature (399)..(399): n is a, c, g, or t
  modified_base (481)..(481): a, c, t, g, unknown or other
  misc_feature (481)..(481): n is a, c, g, or t
  modified_base (510)..(510): a, c, t, g, unknown or other
  misc_feature (510)..(510): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagacccaggccaaacgcccccaagtcgttctctatgatgtcactaagcggccctnaggagtccctgatcgattctctggctcaagtctggcaacnccggccctccctgaacatcctctgggctccgagggcctgaggatggaggctgtatttattattgctgctnatatggtaattaccttacttcttttctcgtttcggaactgggaccctaggttcaccgtctaggtcacgcccaagcccaaccnttgtcacttcttcgttcccgcctctcgtntccttctcgttctgg

SEQ ID NO: 340601 - DNA, 530 bp, Homo sapiens
  misc_feature: GZ8MTXP01DP4LJ.11.59.F04.1.454.CMB.2.raw
  modified_base (172)..(172): a, c, t, g, unknown or other
  misc_feature (172)..(172): n is a, c, g, or t
  modified_base (465)..(465): a, c, t, g, unknown or other
  misc_feature (465)..(465): n is a, c, g, or t
tcagcgagagataccacgaccggtgctcgatttagtacacacacttaggggctggggtctcaggatgcagcactctcgggacgtctccaccatggcctgggctctgctcctcctcagcctcctcactcagggcacaggatcctgggctcagtctgccctgactcagccccgntcagtgtccgggtctccgtgggcagtcagtcaccatcccctgcactggaaccagcaatgatgttggtcgttataagtatgtctcatggtaccgcagaacccaggcaaacgccccccaaagtcgttctctatgatgtcactaagccggcctcaggatccctgactcgattctctcggctccaagtctgggacaacacggccctccctgaacactctcgtgggcctccgaggctggacggatggaggcttagggtatttattattgctgctcatgtggaattcctattcttttcncgttcggaacgtcgggaccttacggttccaccggtctaggtccacgcccaaggtcccaaccctcg

SEQ ID NO: 340602 - DNA, 548 bp, Homo sapiens
  misc_feature: GZ8MTXP01ES6HZ.11.59.F04.1.454.CMB.2.raw
  modified_base (141)..(141): a, c, t, g, unknown or other
  misc_feature (141)..(141): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
tcagcgagagataccacgaccggtgctcgatttagtacacacacttagggattggggggctttgtctgggctctgctcctcctcagcctcctcactcagggcacaggatcctgggctcagtctgccctgactcagccccgntcagtgtccgggtctcctgggcagtcagtcaccatccctgcactggaaccagcaatgattgttggtcttaataagtatgtctcatggtaccgnagaacccaggccaaacgcccccaagtcgttctctangatgtcactaagcgccctnaggacgtccctgatcgattctctggctcaagtctggcaacncggcccctcctgaacntctctgggctcaggctgaggatgaggctgtattatattgctgctnatatggaattaccttacttcttttctcgttacggaacttcgggaccacggttccaccgttctaaggtcacgcccaacggtcccaaaccccgtacttcgtacctaacttccttccgttccccaacccttcctaaccgttactcccttctccgcgtggg

SEQ ID NO: 340603 - DNA, 571 bp, Homo sapiens
  misc_feature: GZ8MTXP01BFT1Z.11.59.F04.1.454.CMB.2.raw
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcaacgaacccaggaccaaacgccccccaagtccgttctctatgatgtcactaacgccggcctnaggcgtccctgactcgattctcgtgctccaagtctagggccaacnccggcctccctagaaccatctcgtgggcctcgaggctggagatgagctgagttattatgctgctcgatacgtaggtaacttaccttacttcttttaacgtcgttaccgggtaacttcgggtaaccctacggttccgttacccgttccgttaagggcctaacggacccctaacgggacccctaaccccgttaacttccg

SEQ ID NO: 340604 - DNA, 507 bp, Homo sapiens
  misc_feature: GZ8MTXP01A25O5.11.59.F04.1.454.CMB.2.raw
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
  modified_base (503)..(503): a, c, t, g, unknown or other
  misc_feature (503)..(503): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgactcgattctctggctccaagtctggcaacacggcctccctgaacatctcngggctccaggctgagatgaggctgattattattgctgctnatatggtaatacctacttctttaactcttcggaacttgggacctacggttcaccgttcctaaggcaacgcccaggccaacccngtcg

SEQ ID NO: 340605 - DNA, 525 bp, Homo sapiens
  misc_feature: GZ8MTXP01D853T.11.59.F04.1.454.CMB.2.raw
  modified_base (273)..(273): a, c, t, g, unknown or other
  misc_feature (273)..(273): n is a, c, g, or t
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggccaaaacgccccccaagtcgttctctangatgtcactaagccggccctcaggactccctgatcgattctctggctcaagtctggcaacaccggcccctccctgaacntctctgggctcaggctgaggatgagctgtattatattgcttgctnatagtggaattacctacttcgttttctcgtttcggaactgggaccncggtcaccgtctaggtccacgcccaagcccaacccnttcgcacttcgttcgttccccgccttccncgttcncttctcgctgg

SEQ ID NO: 340606 - DNA, 543 bp, Homo sapiens
  misc_feature: GZ8MTXP01EZ0QR.11.59.F04.1.454.CMB.2.raw
  modified_base (172)..(172): a, c, t, g, unknown or other
  misc_feature (172)..(172): n is a, c, g, or t
  modified_base (316)..(316): a, c, t, g, unknown or other
  misc_feature (316)..(316): n is a, c, g, or t
  modified_base (373)..(373): a, c, t, g, unknown or other
  misc_feature (373)..(373): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctggcagtcagtcaccatcccctgcactggaaccagcaatgatgttggtcttataagtatgtctcatggtaccggcagaacccaggcaaacgcccccaagtcgtctctatgatgtcactaagcgcctnagacgtccctgactcgattctctggctcaagtctggcacacgcctcctgacatctcngggctcgagctgaggatgaggctgattattagtgctagctctatagtggtaacttaccttacttctttttcctcgtttcgggaacttcggggaccctacgggttacccttaccggttccgttaagggcccaacgccccaaacgggttccccaaaccccgttaacgttccg

SEQ ID NO: 340607 - DNA, 766 bp, Homo sapiens
  misc_feature: GZ8MTXP01CVFZK.11.59.F04.1.454.CMB.2.raw
  modified_base (173)..(173): a, c, t, g, unknown or other
  misc_feature (173)..(173): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgntcagtgtccgggtctccgtggcagtcagtcacactcccctgcactggaaccagcaatgatgttggtcttaataagtatgtctcagtcggtaccggacacgaacccaggaccaaaccgcccccctaagtccgttctactatgtatgtacacgtaacgccgacctcgaggacgtccctgacctcgtattcgtctggcctaccgaagtctgggaccaaccgaccggccctacctagaacctacgtccgtcgtcgggtacctaccggaacgggtcgtagggaacggtacgttacgggaggtacgttaggttaaattttaacgtttaagttcggtcccttggtcccttaactaagtttaaaggttaaccggggttaaaccgtttaacccctttaccgtttttcccgttttttaacccgttaccggtttttaacccgggggaaaccgttcccgggggtaaaccccgttaacccgggggtttaccccttaaccccgggtttaccccggttaaaccggggttaccccgtaaccccggggaaacccccgttaaaaccccgggggacccccccttaaaacccccggttaaccgttttccccgg

SEQ ID NO: 340608 - DNA, 524 bp, Homo sapiens
  misc_feature: GZ8MTXP01DLIOU.11.59.F04.1.454.CMB.2.raw
  modified_base (234)..(234): a, c, t, g, unknown or other
  misc_feature (234)..(234): n is a, c, g, or t
  modified_base (396)..(396): a, c, t, g, unknown or other
  misc_feature (396)..(396): n is a, c, g, or t
  modified_base (473)..(473): a, c, t, g, unknown or other
  misc_feature (473)..(473): n is a, c, g, or t
tcagcgagagataccacgaccggtgctcgatttagtacacacacttagggattggggggctttgcctgggctctgctcctcctcagcctcctcactcagggaacaggatcctgggctcagtctgccctgactcagcccccgctcagtgtccgggtctcctgggcagtcagtcaccatcccctgcactggaaccagcaatgatgttgtcgttataagtatgtctcatggtaccgnagaacccaggcaaacgccccccaagtcgttctctatgatgtcactaagcggccctcaggatccctgatcgattctctggctcaagtctggcaacacggcctccccctagaacatctctcgggctccgaggctgagatgagctgtattatatgctgctcatanggaatacctacttcttttctcttacggaacttcgggacctcggtcaccgtctaggtcacgcccaaggcccaaacccntcgttcacttcttcgttccccgcccttcctcgtaactcgcttcgcttgcgg

SEQ ID NO: 340609 - DNA, 706 bp, Homo sapiens
  misc_feature: GZ8MTXP01C4OYM.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtcttaataagtatgtctcagtcggtaccgcacgaacccaggacaaaccgccccaagtcgtctctatgatgacacgtaacgccggcctgacggtacgtccctgacctcgtactttctacgtggaaccttaccgaagtcctacgggacctaaaccgccgggtcccttacccgtagaaacctcgttccgtacgtcggggtaccttacccggagggtccttagggaacgggtattacgggacggtacgttaggttaattttaacgtttacgttcggacttgaccgttactaagttaacggttacggtaaacctttacccttacttttcccgttttaacgtacccggtttacggggtaaaccgttcggggtaaaccctccggggttacccttacccgggtttaccgttaacggggtaccctaaccgggacccccgaaacgggttaccccctaaaccccgttgtttaaccccg

SEQ ID NO: 340610 - DNA, 521 bp, Homo sapiens
  misc_feature: GZ8MTXP01A6QSJ.11.59.F04.1.454.CMB.2.raw
  modified_base (233)..(233): a, c, t, g, unknown or other
  misc_feature (233)..(233): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgnagaacccaggcaaacgcccccaagtcgttctctatgatgtcactaagcggccctcaggagtcccctgatcgattctctggctccaagtctggcaacacggcccctccctgaacatctctgggctcaggctgaggatgaggctgattatactgtctagtcctttgactattaaactggatgtggggtattcgggcggacggaccacgtaccgtcgtaggtcagcccaaggcctcgccccttggtcacgtctcgttccccnccttcctcgtntcctctcgctgcgtcggg

SEQ ID NO: 340611 - DNA, 513 bp, Homo sapiens
  misc_feature: GZ8MTXP01EC1GS.11.59.F04.1.454.CMB.2.raw
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcacatcccctgcactggaaccagcaatgatgttggtcgttataagtatgtctcatggtaccggcagaacccaggacaaacgccccccaagtcgttctctatgatgtcactaagcggcctcgaggacgtccctgactcgtattctctcggctccaagtctggacaacaccggcctcctgaacatctctgggctccgaggctgagatgaggctgatttattagttgcttgctcatagtggtaaattcctacttcttttctcttcggaacttggacctacggttcaccgttcaaggtcngcccagccaacccntc

SEQ ID NO: 340612 - DNA, 713 bp, Homo sapiens
  misc_feature: GZ8MTXP01A8ZJM.11.59.F04.1.454.CMB.2.raw
  modified_base (172)..(172): a, c, t, g, unknown or other
  misc_feature (172)..(172): n is a, c, g, or t
  modified_base (223)..(223): a, c, t, g, unknown or other
  misc_feature (223)..(223): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatccctgcactggaaccngcaatgatgttggtcttatagtatgtctcagtcggtacggcagaaccaggacaaacgcccccaagtcgttctctatgatgtacacgtaacgccggcctagacggtacgtccctgactcgtattcgtctggacctccaagttctcgggaccaaccgtaccgggtccctacccgtacgaaacctacgttccgttcgtcgggggtacccttacccggtaacggggtcccttacgggaagggtacgttacgggaaacgggtcctttagggttaacgttttaagtttaacggtttcggtaccgttggtccttactaagttaacgttacgggtaaacgttacccctttaaccgtttccttttaaccgttaccgtttacggggtaaacccttcggggttaaaccccgtacgggttacccgttacccggttaccgtttaacgggtcccgtaaccggaccccccgtaaagggacccccctaaaccccgttcgttaaccg

SEQ ID NO: 340613 - DNA, 665 bp, Homo sapiens
  misc_feature: GZ8MTXP01DYPZ1.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcaggtcgtccgggtctccgtgggcagtcagtcaccatccctgcactggaaccagcaatgatggttggtacttaataagtatgtctcagtggtaccggcaacgaaacccaggaccaaacgcccccctaagtccgttctctatgatgtcacgtaagcgcctgaggactcctgtactcgtattctcgtcggtacctaccgtaagtcgtacgggacctaaccgacccgggtcccttacccgtaataactcttccgtcggtcggtcctacgaggtcgtaggaggtagtggacgttacgttagttaacgtttaagttagttcgtacgttcgtactagttaagttaacgtacggttaaacctttacctttacgtttccttttccgttacggttacggtaacggttccggtaacccgtacggttacccgttaccggttacccgtaacggtacccgaacccggtacccgaaccgttacccctaacccgttcgttaaccg

SEQ ID NO: 340614 - DNA, 536 bp, Homo sapiens
  misc_feature: GZ8MTXP01DKRXD.11.59.F04.1.454.CMB.2.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
  modified_base (479)..(479): a, c, t, g, unknown or other
  misc_feature (479)..(479): n is a, c, g, or t
tcagcgagagataccacgaccggtgctcgatttagtacacacacttagggattggggggctttccctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgttctctatgatgtcactaacgccggccctcgaggacgtccctgactcgattctctggctccaagtctggcaacncgcctccccngacntctcgtcgggctcgaggctgagntgagctagtattattatgctgctcatanaggtaatccttacttcttttcgtcgttacggaactcgggacctcggtctaccgtctagtccacgcccaagcccaacccntcgctaccttcttaccgttcccacccttcctacgttctcctcgttcgtcgttggcgg

SEQ ID NO: 340615 - DNA, 519 bp, Homo sapiens
  misc_feature: GZ8MTXP01D525P.11.59.F04.1.454.CMB.2.raw
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
  modified_base (427)..(427): a, c, t, g, unknown or other
  misc_feature (427)..(427): n is a, c, g, or t
  modified_base (480)..(480): a, c, t, g, unknown or other
  misc_feature (480)..(480): n is a, c, g, or t
tcagcgagagataccacgaccggtgctcgatttagtacacacacttaggggctggggtctcaggaggcagcactctcgggacgtctccaccattgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgccccccaagtcgttctctatgatgtcactaagcggcctnaggagtccctgactcgattctctggctcaagtctggcaacncggcctcctagacatctcgtgggcctcgaggctgacggatgaggctgtatttattattgcttgctnatatgtaacttaccttacttcttttctcttcggtaacttgggacctcggttcnccgttctaaggtccaacgccccaggccctaacccgctcg

SEQ ID NO: 340616 - DNA, 562 bp, Homo sapiens
  misc_feature: GZ8MTXP01EH4SC.11.59.F04.1.454.CMB.2.raw
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (448)..(448): a, c, t, g, unknown or other
  misc_feature (448)..(448): n is a, c, g, or t
  modified_base (535)..(535): a, c, t, g, unknown or other
  misc_feature (535)..(535): n is a, c, g, or t
tcagcgagagataccacgaccggtgctcgatttagtacacacacttagggattggggctgggagaggagcccagcactagaagtcggcggtgtctccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggacgtccctgagactctcctgtacngcctctgcttcacctnatacctangcatgcacgtgggtccnccagacctccgaggcgagggggctggaggtgggtgctagtttatttccattatgtaataggaaaaaattgtgtaactttcgtattacgagtacctcggtaggaacgggcctattccgaccgtctaccagacgacactaccagcaacncgctgtatctagacaaatcgaacacgcctagagacgcgaaggacgacgacggttcgtgtagttagttcgttgtaagacgtaaagttnttacgttagtaaggttaagggtaacgg

SEQ ID NO: 340617 - DNA, 549 bp, Homo sapiens
  misc_feature: GZ8MTXP01ETBO1.11.59.F04.1.454.CMB.2.raw
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaaatgatgttggtcttataagtatgtctcatggtaccggcagaacccaggacaaacgccccccaagtccgttctctatgatgtcactaagcggccctnaggacgtccctgactcgtattctctggctcaagtctggcaacgacggcctcctagaacatctctgggctcgaggctagaggtancgaggctagtattagttatgctgctntatagtggtaacttaccttacttctttctcgttcggaaacttcgggacctcgggttaccaccgttcgtaacgggtcaaccggacccaacggacccctaacccgttaacttccg

SEQ ID NO: 340618 - DNA, 755 bp, Homo sapiens
  misc_feature: GZ8MTXP01CYOPD.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccatccctgcactggaaccagcaatgattgttggtcttaataagtatgtctcagtggtaccgcacgaaccaggaccaaacgcccccaagtccgttactctatgatgtacactaagccgcctcgaggacgtcctgactcgtattctctcggactaccgtaagtctaggaccaaccgaccggtccctacctacgaaacctcgttccgtacgtcggggtcccttacccggaacgggtccgttaagggaacgggtaagttcggggaacgggttaccgtttaagggttaaactttttaacgttttaagtttcggaccctttggaccctttactaaaggtttaaacgttaaccgggggtaaaaccgtttaccccttttaacttttcccggttttttaacccgttacccggttttaaccgggggaaaacccgtttcccggggggaaacccctttacccgggggttacccttaccccggggtttaccccgtttaagggtccccgtaaccggtaccccccgtaaacgggacccccctaaaacccccgttcgttaacccgg

SEQ ID NO: 340619 - DNA, 732 bp, Homo sapiens
  misc_feature: GZ8MTXP01ALP1P.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgatgttgtcgttataagtatgtctcagtcggtaccgcacgaacccaggacaaacgcccccaagtcgttctactatgatgtacactaacgccggcctgacggactccctgactcgtattctctggacctaccgaagtctcgggacctaaccgaccgggtccctaccctagaaacctcgttccgtcggtcggggccttacccggaacgggtccgttagggaacgggtagttacgggaacgggtcctttagggttaacgttttatttaacgtttcggtccttacggtccttaaccgtaagtttaacggttacgggtaaacccgtttacccctttaactttcccgtttttaaccgtaccgggttttaaccgggtaaacccgttccgggggtaaaccccgtacccgggtttacccgttaccccggtttacccggttaacggggttcccctaaccgggtacccccgtaaaaccgggacccccctaaaaccccgttcgttaaccccg

SEQ ID NO: 340620 - DNA, 559 bp, Homo sapiens
  misc_feature: GZ8MTXP01EFD39.11.59.F04.1.454.CMB.2.raw
  modified_base (343)..(343): a, c, t, g, unknown or other
  misc_feature (343)..(343): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaaaacgccccccaagtcgttctctatgatgtcactaagcggcctgagagtccctgactcgattcnctcggctccaagtctgggacaaccgacggcctccctagaacctatctcgtgggccttccgaagggctaggaggatgaaggngtgtagttattattgtcgtgtctntatagtagtaacgttaccttacttctttcttcgttacgtacgttacggtaccgtacgttacgttccgttaccgtaacgtacgaacgaccgaccgacctaacccgaacgtcg

SEQ ID NO: 340621 - DNA, 542 bp, Homo sapiens
  misc_feature: GZ8MTXP01CU6GG.11.59.F04.1.454.CMB.2.raw
  modified_base (172)..(172): a, c, t, g, unknown or other
  misc_feature (172)..(172): n is a, c, g, or t
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
  modified_base (442)..(442): a, c, t, g, unknown or other
  misc_feature (442)..(442): n is a, c, g, or t
  modified_base (538)..(538): a, c, t, g, unknown or other
  misc_feature (538)..(538): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctggcagtcagtcaccatcccctgcactggaaccagcaatgatgttggtcttaataagtatgtctcatggtaccgcagaacccaggacaaacgcccccaagtcgttctctatgatgtacactaagccgcctnagacgtcctgactcgattctctggactaccgaagtctggaccaacgacggccctcctagaaactntccgtcgtgggcctcccgaggtctggaggatgagctgtattattattgactgcttanatagtagtaacttaccttctttctttctcgttacggtacgttcggtaccgtacgttccgttccgttcgtaacgcaacgaccgacgaccctaaccgngtcg

SEQ ID NO: 340622 - DNA, 581 bp, Homo sapiens
  misc_feature: GZ8MTXP01A6DK3.11.59.F04.1.454.CMB.2.raw
  modified_base (428)..(428): a, c, t, g, unknown or other
  misc_feature (428)..(428): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcgttatagtatgtctcatggtaccggcagaacccaggacaaaccgccccccaagtccgttctctatgatgtcactaacgcggcctgacggacgtccctgactcgtattctctggcctaccgaagtctgggacctaaccgaccggccctccctagaacctactccgtcgtgggcctccgagggtctgaaggntgaggtcttaggtatttagttagttgcttagcttcagttatacggtaacttaccttactttcttttaactcgttacggaacgttcgggaaccctcggttccgaccgttcgttaaggcctaacgaccccgaacggcccctaacccgttcgtccg

SEQ ID NO: 340623 - DNA, 555 bp, Homo sapiens
  misc_feature: GZ8MTXP01AJ0WS.11.59.F04.1.454.CMB.2.raw
  modified_base (469)..(469): a, c, t, g, unknown or other
  misc_feature (469)..(469): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcttataagtatgtctcatggtaccggcacgaacccaggaccaaacgccccccaagtcgttctctatgatgtcactaagccggccctcaggacgtccctgactcgattctctggcctccaagtctgggcaacgacggcctcctagaacatccgtcgtcgggcctccgaggtctggacggatgaggctagatttatagttgcttgctcatatggtaactacctacttcttttcnctttacggaacgttcgggacctaacgggttccacccggttcctaacgggtaccaacgccccaacggttccccaaaccccgcgtccg

SEQ ID NO: 340624 - DNA, 535 bp, Homo sapiens
  misc_feature: GZ8MTXP01BG6EI.11.59.F04.1.454.CMB.2.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (345)..(345): a, c, t, g, unknown or other
  misc_feature (345)..(345): n is a, c, g, or t
  modified_base (444)..(444): a, c, t, g, unknown or other
  misc_feature (444)..(444): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgtctctangatgtcactaagccggcctnaggagtccctgatcgattctctggctccaagtctggcaacaccggcccctcctgaacntctctgggcctccgaggctggacggatgagtctagtatttatattgctgctacatatagtaacgtacttacttcttttctcgttacggaactggacccnggtcaccgtcgtaggtcacgcccaaggcccacccgtattcgtctacttcgttcgttccccgccttcctcgttactccgttctccgcgtcgg

SEQ ID NO: 340625 - DNA, 309 bp, Homo sapiens
  misc_feature: GZ8MTXP01ERVCX.11.59.F04.1.454.CMB.2.raw
  modified_base (305)..(309): a, c, t, g, unknown or other
  misc_feature (305)..(309): n is a, c, g, or t
tcagcgagagataccacgaccggtgctcgatttagtacacacacttagggattgggcagcctgacatctgaggacacggccatatattactgtgcaatcagttataggacgtcgtccgagggctactttgactcttggggccagggaaccctggtcaccgtctcctcagcctccgaccaagggcccatcggtcttccccctggcgccctgctccaggagcacctccgagagcacagcggccctgggctgcctggtcaaggactacttccgtatctctcgctgagcgggctggcaaggcgcatagnnnnn

SEQ ID NO: 340626 - DNA, 649 bp, Homo sapiens
  misc_feature: GZ8MTXP01AUOS4.11.59.F04.1.454.CMB.2.raw
  modified_base (642)..(642): a, c, t, g, unknown or other
  misc_feature (642)..(642): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcacgaacccaggacaaacgcccccaagtcgttctctatgatgtacactaacgccggcctcgacggacgtccctgactcgtattcctcgtcggacctaccgaagtcctacgggaccaaaccgaccgggtccctcccctaggaaacctcttccgtcgtcggggccttccgaacgggtctagggaacgggagttacggaaggtcttaggtaacgtttatttagttcgcttcgtccttactaagttacgtacggtaaacgttacccttaccgtttccttttcgtacgtttaccgggtaacttccggggtaaccctaccgggttccttacccggttaccgtaacgggtccaaccggaccccgaacggcccccaaaccccgttntaacccg

SEQ ID NO: 340627 - DNA, 567 bp, Homo sapiens
  misc_feature: GZ8MTXP01DH7KX.11.59.F04.1.454.CMB.2.raw
  modified_base (431)..(431): a, c, t, g, unknown or other
  misc_feature (431)..(431): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtcttaataagtatgtctcatggtaccggcacgaacccaggaccaaacgcccccaagtcgttctctatgatgtacactaagcgcctgaggactcctgactcgattctctggcctcaagtctcggacaacgccgcctccagaactatctcgtgggcctccgaggtctaggagatgagctagtatttacttagttncgtgtcctgaattaagtggtaaacttacccttactttcttttcgtcgttacggaacgttcgggaacctcggttcccgttaccgttcccgttaaggaccaacggtacccaaacggcccctaaacccgttctaacccg

SEQ ID NO: 340628 - DNA, 525 bp, Homo sapiens
  misc_feature: GZ8MTXP01AOCX1.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttatagtatgtctcatggtaccgcagaacccaggcaaacgcccccaagtcgtctctatgatgtcactaagcggccctcaggagtccctgactcgattctctggctccaagtctgggacaacacggcctccctagaaccatctctgggcctccgaggctggagatgaggctgatttattattgctgctcatacgtggtaactcctacttctttctcgttacggaacttcgggacctacggttcaccgttccgtaaggtcaacgcccaacggccccaacccgcgtccg

SEQ ID NO: 340629 - DNA, 543 bp, Homo sapiens
  misc_feature: GZ8MTXP01EDPW9.11.59.F04.1.454.CMB.2.raw
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggccaaaacgccccccaagtcgttctctangatgtcactaagcggccctnaggatccctgatcgattctctggctcaagtctggcaacacggcccctcctgaacatctctgggctcgaggctgagatgagctgatttatattgctgctanattanggtaaattaccttacttcgttttctcgttacggaacttgggaccctacggtcctaccggtctaagggtccacgccccaacggccccaaaccctcttgtcctacttccgttcgttccccaacccttctcgtactccttctcgcgtgg

SEQ ID NO: 340630 - DNA, 627 bp, Homo sapiens
  misc_feature: GZ8MTXP01BLRAT.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctgggcagtcagtcaccatcccctgcactggaaccagcaatgattgttggtacttataagtatgtctcagtcggtaccggcaacgaacccaggaccaaaccgcccccaagttccgttctctatgatcgtacaactaacgccggcccctgacggacgtccctgactcgtattcgtctcggacctaccaagtcctcggaccaaaccgccggtccctacccgtagaaacctactccgtcgtcgggccttaccgacggtctaggaggtatcggaggtctagtatttatttatgtacttgcctatagttacgtaggtaacttaccttactttcttttcgtacgttacggtaaacgttcggggaaccctaccgggttcttacccggttccgtaagggtcctaacgggtaccccaaacgggcccctaaaccccgttaagttccg

SEQ ID NO: 340631 - DNA, 306 bp, Homo sapiens
  misc_feature: GZ8MTXP01EJBPC.11.59.F04.1.454.CMB.2.raw
  modified_base (297)..(297): a, c, t, g, unknown or other
  misc_feature (297)..(297): n is a, c, g, or t
  modified_base (303)..(306): a, c, t, g, unknown or other
  misc_feature (303)..(306): n is a, c, g, or t
tcagcgagagataccacgaccggtgctcgatttagtacacacacttagggattgggcagcctgacatctgaggacacggccatatattactgtgcaatcagttataggacgtcgtccgagggctactttgactcttggggccagggaaccctggtcaccgtctcctcagcctccaccaagggcccatcggtcttcccctggcgccctgctccaggagcacctccgagagcacagcggccctgggctgcctggtcaaggactacttccgtatctctcgctgagcgggctggcaaggcncatagnnnn

SEQ ID NO: 340632 - DNA, 624 bp, Homo sapiens
  misc_feature: GZ8MTXP01B8V2X.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtacttatagtatgtctcagtggtaccgcacgaacccaggaccaaaccgcccccaagtccgttactctatgatgtacaacgtaacgccggcctacgacggacgtccctagtactcgtatttctcgtcggtacctaccgtaagtcctagggaccaaaccgaccggtccctacccgtagaacctatccgtcgtacgggcttaccgaggtctaggagatggagtactagttaagtttatttagttcgcttgcctataattagtacggtaacttacccttactttccgttttctcgtttacgggaaccgttcgggaaccctacgggttcccgttaccgttccgtaacgggtaccaacggacccgaacggacccctaacccgttcgttccg

SEQ ID NO: 340633 - DNA, 701 bp, Homo sapiens
  misc_feature: GZ8MTXP01B3HB2.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgatgttggtcttaataagtatgtctcagtcggtaccgcaacgaacccaggaccaaaccgccccccaagttccgttctctatgatgtacacgtaacgccggtcctcgacggacgtccctgacctcgtattcgtctcggtacctaccgaagttctacgggaccaaaccgtaccgggtccctacccgtacgaacctagttcccgtcggtcggggtcccttacccggaacgggtcctagggaacgggtagttcgggaacggtcgttaggttaatttagtttagttcggtacttcgtaccttactaagttacggtacggttaaaccgttaccctttactttcctttttaaccgtacgtttaccgggtaaaccgttcgggtaaaccccgtacggttacccgttaaccccggttccgttaacgggtaccgaacccggtaccccgaaaccggaccccctaaaccccgttcgttcccg

SEQ ID NO: 340634 - DNA, 611 bp, Homo sapiens
  misc_feature: GZ8MTXP01CIVB6.11.59.F04.1.454.CMB.2.raw
  modified_base (259)..(259): a, c, t, g, unknown or other
  misc_feature (259)..(259): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccactcccctgcactggaaccagcaatgatgttggtcgttataagtatgtctcagnggtaccggcacgaacccaggacaaaccgccccctaagtccgttctctatgatgtacacgtaagccggcctcgacggacgtccctgactcgattctcgtcggctccaagtctaggccaaacncggcctccctgaacntctcgtgggcctccgaggtctgaggactggaggtctagtatttagtttacttggcttggctctaagttagtcgggtaaactttacccttactttcctttttccgtcgttttacgggaaacgttcgggggtaacccctaacgggttcccgaaccggtttcccctaaggggttcccaacggccccgaaacgggttcccccaaaccccttcggtttccg

SEQ ID NO: 340635 - DNA, 627 bp, Homo sapiens
  misc_feature: GZ8MTXP01EKQEL.11.59.F04.1.454.CMB.2.raw
  modified_base (404)..(404): a, c, t, g, unknown or other
  misc_feature (404)..(404): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgattgtggtcttataagtatgtctcagtggtaccgcagaacccaggacaaacgcccccaagtcgtctctatgatgtacactaacgcggccctagacggacgtcccgtgtactccgtattcgtctcggacctaccgaagtctcgggaccaaccgccgggtcctccctagaaccntcctcgtgggcctccgaggtctggacggatcgaggtcttgtaatttattagttgctgctactattacgtaggtaacttaccttactttcctttcgttccgtttacgggtaaacgttccggggtaaccccgtacgggttaccccgttacccggttacccgttaaacgggtcccgaaccggtaccccgaaaccgggaccccctaaacccccgttaacttaacccg

SEQ ID NO: 340636 - DNA, 572 bp, Homo sapiens
  misc_feature: GZ8MTXP01EGFQA.11.59.F04.1.454.CMB.2.raw
  modified_base (326)..(326): a, c, t, g, unknown or other
  misc_feature (326)..(326): n is a, c, g, or t
  modified_base (463)..(463): a, c, t, g, unknown or other
  misc_feature (463)..(463): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtcttataagtatgtctcagtggtacggcaacgaacccaggacaaacgcccccaagtcgttctctatgatgtcacgtaagccggcctnaggacgtccctagtactcgtattctcgtcggaccttaccaagtctgggaccaacgaccggccctccctagaactactcgtcgtcgggcctccgaggtctaggaggatgaggtctagtagtttattagttgctgtctntatagtagtagtacttacttctttcttcgttcggtacgttacggtacgtacgttccgttccgttccgtaacgtacgaacgaccgaccgacccaacccgaaccgtaaccg

SEQ ID NO: 340637 - DNA, 561 bp, Homo sapiens
  misc_feature: GZ8MTXP01BI4LD.11.59.F04.1.454.CMB.2.raw
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (557)..(557): a, c, t, g, unknown or other
  misc_feature (557)..(557): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatgttggtcgttataagtatgtctcatggtaccggcacgaacccaggaccaaacgcccccaagtccgttctctatgatgtacactaacgcggcctcgaggacgtccctgactcgattctctcggactccaagtctgggaccacaccggcctccgtagaactgtcctcgtcgggctccgaggctagaggatgagctagtattattntgctgcctnattagtaggtaacgttacccttacgttcttttctcgttacggaacttcgggacctacgggttccttccgttccgtaaggtccaacgtacccgacggacccctaaccccgttntccg

SEQ ID NO: 340638 - DNA, 629 bp, Homo sapiens
  misc_feature: GZ8MTXP01B60C4.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcagtggtaccgcagaacccaggaccaaacgcccccaagtccgttctctatgatgtacactaagccggcctcgaggacgtccctgacctcgattctctggcctaccaagtctcgggaccaacgaccggtccctccctagaacctatcctcgtcgggcctccgaaggtctggacggatggaggcttaggtaatttagttagttcgcgttgtccttacgagttaacgttggtaaaccgtttacccttaacgtttcctttttccgtccgttttaccgggaaaccgttcggggaaccctaccgggttacccttacccggttccgtaacgggtaccaaccggtaccccgaacgggttaccccaaaccccgttaacgttccg

SEQ ID NO: 340639 - DNA, 587 bp, Homo sapiens
  misc_feature: GZ8MTXP01EBOR9.11.59.F04.1.454.CMB.2.raw
  modified_base (479)..(479): a, c, t, g, unknown or other
  misc_feature (479)..(479): n is a, c, g, or t
  modified_base (583)..(583): a, c, t, g, unknown or other
  misc_feature (583)..(583): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtccaccactcccctgcactggaaccagcaatgattgttggtacttataagtatgtctcagtcggtaccgcacgaacccaggacaaaccgcccccaagtcgttctctatcgtatgtacacgtaacggccggaccctagacggtactccctgactcgtattctctcggcctaccgaagtcctcgggacccaaccgaccggtccctaccgtacgaacctcgttctcgtcgggccttacccgagggctaggaggtatggaggtcttaggtatttaagttntcgtctgtctatagttagtacgtaacttaccttctttctttctcgttacgacgttcggaccgtcgttcgttacgttcgtaagcaaccgccacgaccctaaccgngtcg

SEQ ID NO: 340640 - DNA, 647 bp, Homo sapiens
  misc_feature: GZ8MTXP01C81H6.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtgtccgggtctccgtgggcagtcagtcaccatccctgcactggaaccagcaaatgattggttggtcttaataagtatgtctcaagtcggtaccgcaacgaacccgaggaccaaacgcccccctaagtcgttctactatgatgtacaacgtaacgccggcctagaggacgtccctgtactcgtattcgtcgtcggtacctacctaagtcgtacgggaccaaacgaccggccctacccgtagaactactcgtcgtgggcctccgaggctaggaggataggaggtactagttaagttttattaaggttcgacgtcgtctagtaagttaacgtaacggtaaacctttaccttacctttcgtttccgtacggttacgggtaaaccgttcgggaaacccgtaccggttacccgttaccggttccggtaacgtaccgaaccgaaccccgaaccggacccctaacccgttcgtaacg

SEQ ID NO: 340641 - DNA, 641 bp, Homo sapiens
  misc_feature: GZ8MTXP01EB2YV.11.59.F04.1.454.CMB.2.raw
  modified_base (584)..(584): a, c, t, g, unknown or other
  misc_feature (584)..(584): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgcactggaaccagcaatgatgttggtcgttataagtatgtctcagtcggtaccgcacgaacccaggaccaaaccgcccccaagtccgttctctatcgtatgtacacgtaacgccgcctgacggacgtccctgtactcgtacttctcgtcggcccttacgaagttcgtacggaccaaccgaccgggtcccttaccctagaaacctgttccgtcgtcggggtccttacccggaagggtccttagggaggtaatgggaaggtcgttagtaatttttagtttacgttggccttgccttagtaagtagtacgggtaacttacccttactttcttttctacgttacgggtacgttgggaaccctacgggttccnccgttaccgtaaggtccaaccggccccgaacggaccctaaaccccgttcgttaaccg

SEQ ID NO: 340642 - DNA, 549 bp, Homo sapiens
  misc_feature: GZ8MTXP01AWVDS.11.59.F04.1.454.CMB.2.raw
  modified_base (172)..(172): a, c, t, g, unknown or other
  misc_feature (172)..(172): n is a, c, g, or t
  modified_base (325)..(325): a, c, t, g, unknown or other
  misc_feature (325)..(325): n is a, c, g, or t
  modified_base (446)..(446): a, c, t, g, unknown or other
  misc_feature (446)..(446): n is a, c, g, or t
  modified_base (503)..(503): a, c, t, g, unknown or other
  misc_feature (503)..(503): n is a, c, g, or t
  modified_base (544)..(544): a, c, t, g, unknown or other
  misc_feature (544)..(544): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccggtctcctgggcagtcagtcaccatccctgcactggaaccagcaatgatgttgtcttataagtatgtctcagtggtaccggcaagaacccaggaccaaacgccccccaagtccgttctctatgatgtacactaagtcggccctnaggacgtccctgactcgattctctggacctccaagtctgggcaacgaccggccctccgtagaacctatctcgtgggcctcgaggctaggaggatgaggctagtatttattagttgctgctnatagtgtaacttcctacttctttctcgttacggaacgttcgggaacctcgggttccnccggttcctaagggtcaacgaccccgaggcccctaacccgngtccg

SEQ ID NO: 340643 - DNA, 594 bp, Homo sapiens
  misc_feature: GZ8MTXP01EWXIO.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgattgttggtcttataagtatgtctcagtggtaccggcacgaacccaggacaaacgccccccaagtcgtctctatgatgtcactaacgcggcctgaggacgtccctgactcgtattctctcggacctccaagtctgggaccaacgaccggcctcctagaacatctcgtgggcctcgaggctaggacggatgaggtcttagtaatttagtttaattgcgttgctcaagttacgttacgggtaaactttaccttaactttcctttttctccgtttacggaaacgttcgggaaccctacgggttccttacccgttccgtaagggtccaaccggacccgaacggcccctaaacccgttcgttaaccg

SEQ ID NO: 340644 - DNA, 595 bp, Homo sapiens
  misc_feature: GZ8MTXP01BOGPG.11.59.F04.1.454.CMB.2.raw
  modified_base (252)..(252): a, c, t, g, unknown or other
  misc_feature (252)..(252): n is a, c, g, or t
  modified_base (586)..(586): a, c, t, g, unknown or other
  misc_feature (586)..(586): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtntcatggtaccggcagaacccaggacaaacgcccccaagtcgtctctatgatgtacactaagcgcctcagacgtccctgactcgattctctggctaccaagtctacgggcaaaccgaccggccctccctagaaacctatccgtcgtcggggaccttccgaacgggccttaggacgggatcggaagggtcttaggtagtttatttacgttgccttgtcctgattaagtggtaaacttccttacttcttttccgtacttaccgggaacttcggggaaccctcgggttcccgaccgttccgtaagggtaccaacgaccccgaacggcccctaaccccngttaacccg

SEQ ID NO: 340645 - DNA, 704 bp, Homo sapiens
  misc_feature: GZ8MTXP01BTEA6.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtcttatagtatgtctcagtcggtaccggcacgaacccaggaccaaacgccccccaagtcgttctctatgatgtacacgtaacgccggccctgaggtactccctgactcgtattctctggcctacaagtctgggaccaaaccgccggtccctcctagaactacttcctcgtcgggcctaccgagggtcctaggacggtagtcgggaggtacttaggttaacttttaacgtttagtttcggctttggaccttacgtaagtttaaacggttacggggtaaaccgtttaccctttaaccttttccgtttttcccgttaaccggttttaccggggtaaaacccggtttcgggggtaaaccccgttaaccggggttaccccttaccccgggtttacccgttaacggggttacccaacccgggtacccccgaaaacgggttacccccctaaacccccgttaacggtttccccg

SEQ ID NO: 340646 - DNA, 655 bp, Homo sapiens
  misc_feature: GZ8MTXP01B5TYO.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgcactggaaccagcaatgatgttggtcttataagtatgtctcagtcggtacggcaacgaacccaggaccaaaccgcccccaagtccgttctctatgatgtacacgtaacgccggcctgacggacgtccctgactcgtattctcgtgacctaccaagtctacgggacctaaccgaccggtccctacccgtaagaacctacttccgttcggcggggtacccttacggaacgggtctagggaagggtagttagggaacgggtcttaaggttaattttaagtttacgtttcggcctttagcgttacctaagttaacggtacggtaaacctttacctttacctttcttttccgtcgttacgggaaaccttcgggaaccctacgggttccttaccgttcccgtaaggccaaccgaccccgaacggacccctaaacccgttgtccg

SEQ ID NO: 340647 - DNA, 570 bp, Homo sapiens
  misc_feature: GZ8MTXP01EKQ0Y.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtacttataagtatgtctcagtcggtaccgcacgaacccaggaccaaacgcccccaagtccgttctctatgatgtacactaacgccgcctgaggacgtccctgactcgtattctctggacctacgaagtctcggaccaaaccgccggccctcccgtagaactatctcgcggcctcgaggtctggaggatcggaggtctagtagtttattagttgctgctctatagtggtaaacttaccttactttctttctcgttacggaaccgttcgggacctcggttccttaccgttcgtaacggcaaccgtcccacggacccctaacccgcgttaaccg

SEQ ID NO: 340648 - DNA, 593 bp, Homo sapiens
  misc_feature: GZ8MTXP01CLD8L.11.59.F04.1.454.CMB.2.raw
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccggtctcctggcagtcagtcaccatccctgcactggaaccagcaatgatgttggtacttatagtatgtctcatggtaccgcacgaacccaggacaaacgccccctaagtcgttctctatgatgtcactaagcgcctnaggtactcctgactcgattctctcggactaccaagtcctggacctaacgccggtccctccagaaactcttcctcgtacgggcttaccgaggtctggaggtanggagtctagtaagtttattagtttgctgctcaattagtaggtaacgttaccttacttccttttcgtcgttacggtaaaccgttcggggtaaaccctccgggttaccttacccggttaccgtaagggtcccaacggtaccccaacgggttacccctaaccccgttaagttcccg

SEQ ID NO: 340649 - DNA, 639 bp, Homo sapiens
  misc_feature: GZ8MTXP01D0Q3E.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgcacgtgaaccagcaatgatgttggtacgttatagtatgtctcagtcggtaccgacacgaacccgaggaccaaaccgccccctaagtccgttctctatgatgtacacgtaacgccggcctagacggtactcccgtgtactcgtattcgtcgtcggacctaccgaagtctcgggaccaaccgaccggtccctccgtagaacctcttccgtcgtcgggtcctaccgaggtctaggacggataggagtactagttaatttattagttcgctgtctagtaagttacgtacggtaaacttaccttactttccgttttaacgtcggtttaccgggtaacgttcgggtacccgttaaccgggttccgttacccggttcgtaacggtacccaaccggaccccaaccggacccctaacccgttcgtaacccg

SEQ ID NO: 340650 - DNA, 583 bp, Homo sapiens
  misc_feature: GZ8MTXP01CM4FL.11.59.F04.1.454.CMB.2.raw
  modified_base (483)..(483): a, c, t, g, unknown or other
  misc_feature (483)..(483): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcacactccctgcactggaaccagcaatgtatgttggtacttataagtatgtctcagtcggtaccgacacgaaacccaggaccaaaccgccccctaagtccgttctctatgtaatgtacacgtaacgccggcctcgacggtactccctgacctcgtattcgtctcggacccttaccgaagtctacgggaccaaccgaccggtccctacctagaactactctcgtcgggcctccggaggtctaggacggatcggaggtctagtatttacgttatgctgctanataagtggtaacttccttactttctttctcgttacggtacttcggaacctcggttccaccgttcgtaaggaccaacgcccgaacgccctaacccgctccg

SEQ ID NO: 340651 - DNA, 576 bp, Homo sapiens
  misc_feature: GZ8MTXP01CBKYQ.11.59.F04.1.454.CMB.2.raw
  modified_base (256)..(256): a, c, t, g, unknown or other
  misc_feature (256)..(256): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctcctgggcagtcagtcaccatcccctgcactggaaccagcaatgatgttggtcgttataagtatgtctnatggtaccgcacgaacccaggacaaacgccccctaagtcgttctctatgatgtacactaacgcgcctgaggacgtcccngactcgtattctctgctcaagtcngcacncgcctccagacntctcgcggctcgngctgaggatgagctgtatttattagttcgctgctcagttagtaggtaacgtaccttaccgtttccttttctacggtttccggaaaccgttcgggtaacccgtcgggttcccgttacccggttcccgtaacggggttcccaaccggtaccccgaaaccggacccctaaacccccgttaacgtttcccg

SEQ ID NO: 340652 - DNA, 605 bp, Homo sapiens
  misc_feature: GZ8MTXP01ASCMN.11.59.F04.1.454.CMB.2.raw
  modified_base (244)..(244): a, c, t, g, unknown or other
  misc_feature (244)..(244): n is a, c, g, or t
  modified_base (399)..(399): a, c, t, g, unknown or other
  misc_feature (399)..(399): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgccactggaaccagcaatgatgttggtcgttanaagtatgtctcatggtaccgcagaacccaggacaaacgccccccaagtcgtctctatgatgtcactaagcggccctgacggagtcccctgactcgtattcctctggacctccaagtctgggaccaaacgccgggtccctcccctaggaaaccctnttccgtccgtcggggccttcccggaggtccgttaggaacgggattcgggaaggtcgttgtagttaatttaattgtcgtcgtcgtctatagtacggtaacgtaaccttaacctttctttccttcgttacggtacgttcggtaccgtaaccgttccgttaccgttccgtcgtcgaacgacccgaccggacccaaccccgaaccgtccg

SEQ ID NO: 340653 - DNA, 532 bp, Homo sapiens
  misc_feature: GZ8MTXP01BCP6O.11.59.F04.1.454.CMB.2.raw
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccggtctcctggcagtcagtcaccatcccctgcactggaaccagcaatgatgttggtcgttataagtatgtctcatggtaccggcagaacccaggcaaacgcccccaagtcgtctctatgatgtcactaagccgtcctcaggagtccctgactcgattctcnggctccaagtctaggcaacgcgcctccngaacagtctgtcgggcttccgagtctggaggatgagcgtgagttattattgtcgtgctctatatagtacgttactacttctttcttcttcgtacgttcggtaccgtacgttcgttccgttccgtaacgtcgaacgaccgaccggacccaacccgaaccgtccg

SEQ ID NO: 340654 - DNA, 700 bp, Homo sapiens
  misc_feature: GZ8MTXP01AS52S.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccatcccctgcactggaaccagcaatgatgttggtacttataagtatgtctcagtggtaccggcacgaacccaggaccaaacgcccccaagtccgttctctatcgatgtacactaacgccggccctagacggactccctgacctcgattcctctcggcctaccgaagtcctagggacctaaccgaccgggtccctaccgtacgaacctagttccgtcgtcggggtccctaccgacgggtcctaggaggtacgtggtaacggtcgttaggttaagttttatttacgtttcggaccttagtcccttactaacggttaagttacgggtaaacctttaccctttaacctttccgtttttaaccgtccggtttaaccggggtaaaccgttcggggtaaaccccgtaccggggttacccttacccgggtttacccgttaaacggggtcccaacccgggtaccccgtaaaccgggaccccctaaccccgttaacgttcccg

SEQ ID NO: 340655 - DNA, 559 bp, Homo sapiens
  misc_feature: GZ8MTXP01ASK2U.11.59.F04.1.454.CMB.2.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
  modified_base (554)..(554): a, c, t, g, unknown or other
  misc_feature (554)..(554): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctggcagtcagtcaccactcccctgcactggaaccagcaatgatgttggtcttaataagtatgtctcagtggtaccggcacgaacccaggaccaaacgccccccaagtcgttctctatgatgtacacgtaacgccggccctcgaggtacgtccctgactcgtattcncgtcggactcaagtctggaccaaacnccggcctcctagactatcctcgtggcctcgagctgaggntgaggtctagtatttattagttgctgctcgtatagtcggtaaacttccttacttctttctcgttcggtacttggaccctacgggttcttacccgttcgtaacggtcaaccgtcccgaacgttccccaacccgnttccg

SEQ ID NO: 340656 - DNA, 313 bp, Homo sapiens
  misc_feature: GZ8MTXP01C4FOA.11.59.F04.1.454.CMB.2.raw
  modified_base (236)..(236): a, c, t, g, unknown or other
  misc_feature (236)..(236): n is a, c, g, or t
  modified_base (306)..(313): a, c, t, g, unknown or other
  misc_feature (306)..(313): n is a, c, g, or t
tcagcgagagataccacgaccggtgctcgatttagtacacacacttagggattgggcagcctgacatctgaggacacggccatatattactgtgcaatcagttataggacgtcgtccgagggctactttgactcgttggggccagggaaccctggtcaccgtctcctcagcctccaccaagggcccatcggtcttcccctggccgccctgctccaggagccacctccgagagcacnggcggccctgggctgcctggtcaaggactacttccgtatcctcgctgagcgggctggcaaggcgcatagnnnnnnnn

SEQ ID NO: 340657 - DNA, 601 bp, Homo sapiens
  misc_feature: GZ8MTXP01EOLMR.11.59.F04.1.454.CMB.2.raw
  modified_base (260)..(260): a, c, t, g, unknown or other
  misc_feature (260)..(260): n is a, c, g, or t
  modified_base (357)..(357): a, c, t, g, unknown or other
  misc_feature (357)..(357): n is a, c, g, or t
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcagccccgctcaggtgtccgggtctcctgggcagtcagtcaccatcccctgcactggaaccagcaatgattgttggtacgttaataagtatgtctnatggtaccggcagaacccaggaccaaacgccccccaagtcgttctctatgatgtacaactaagccggccctgacggtactccctgtactcgtattcnctcggacctaccaagtctggaccaaccgaccggccctcccgtagaacattcctcgtcggggcctcgaggctaggaggatgaggtctgtattattgttgctgcctatagttagtaggtaactttacccttactttcttttcgtcgtttacggaaccgttcgggaacccgtacggttcccgttacccggttccgttaacgggcctaaccggaccccgaacgggacccctaaccccgttaacttccg

SEQ ID NO: 340658 - DNA, 578 bp, Homo sapiens
  misc_feature: GZ8MTXP01DP9FK.11.59.F04.1.454.CMB.2.raw
  modified_base (172)..(172): a, c, t, g, unknown or other
  misc_feature (172)..(172): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccggtctcctgggcagtcagtcacatccctgcactgaaccngcaatgatgtgcttatagtntgtctcatggtaccgcacgaaccaggacaaacgcccccaagtcgtctctatgatgtcactaagcggcctnacggcgtcctgactcgtattctcgtcgactcaagtctcgacacgcgctccagacagtctacgtggcctcaaggtctaggaggacttgacggtactagtaactttacgttaacgttcgaccttagcttaccgagttacgtacggtaacgttaccgttacttcgttttctcgttacgggaaccgttcgggtaaccgtacgggttaccaccggttacgtaacgggtcctaacggtacccaacggttcccctaaccccgttaagttaacccg

SEQ ID NO: 340659 - DNA, 611 bp, Homo sapiens
  misc_feature: GZ8MTXP01BWQXJ.11.59.F04.1.454.CMB.2.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcagtggtaccgcagaacccaggccaaacgcccccaagtcgttctctangatgtcactaagccggccctgaggatccctgactcgtattctctgctcagtctgcacacgccctacctgaacatcncgtcggctcgaggctgaggatggagctagtattattattgcttagctactatagtaggtaacttaccttaccgtttcttttacttccgttacgggaacgttcgggggaaccctaccgggttccgtaacccggttccttaagggtcctaaccgggaccccaaaccgggtaccccaaaccccgtcgttcgtaccctaacctttcccgttccgtttaccccctaaccccgttccctcggttactccgttccgtccggttccgtcggg

SEQ ID NO: 340660 - DNA, 655 bp, Homo sapiens
  misc_feature: GZ8MTXP01BUYYK.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctgggcagtcagtcaccactcccctgcactggaaccagcaatgatgttggtacgttaataagtatgtctcagtcggtaccggcacgaacccaggaccaaacgcccccaagtcgttctctatgatgtacacgtaacgccgcctgaggtactccctgactcgtattctctggacctccaagtctacgggaccaaaccgaccggtccctacccgtagaacctatccgtcgtcgggccttccggaagggtctaggacggagtggaaggtcttaggttaatttaagtttagttggccttgtaccttactaattaacggtacggtaaaccgtttaccctttaccgttttcttttaaccgtccgtttacgggtaaccgttcggggtaaccctacgggttacccgttacccggttccgtaagggtcccaaccggtaccccgaaccggttacccctaaccccgttaacgttccg

SEQ ID NO: 340661 - DNA, 603 bp, Homo sapiens
  misc_feature: GZ8MTXP01APODX.11.59.F04.1.454.CMB.2.raw
  modified_base (258)..(258): a, c, t, g, unknown or other
  misc_feature (258)..(258): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgttcagtcgtccgggtctccgtgggcagtcagtcaccatcccctgcactggaaccagcaatgatgttggtcgttataagtatgtctnatggaccggcagaaccagacaaacgccccaagtctctctatgatgtcactaacgccgcctcgaggactcctgactcccgatttctcgtcggacctacccgaagtccgtcgggaccaaaccgacccgggtccctacccgtagaaacctactccttcggtcgggcctccgaggcgtaggacggatggaggtctagttatttagttatcgtctgtctcattagtacggtaacttaccttactttcttttccgtcgttacggacgtacgggcccgtaaacgggtcccttaaccgttcgttaaacgggtccacgaacccgtaacggccccttaaacccctcgttcgtccc

SEQ ID NO: 340662 - DNA, 552 bp, Homo sapiens
  misc_feature: GZ8MTXP01EQILV.11.59.F04.1.454.CMB.2.raw
  modified_base (141)..(141): a, c, t, g, unknown or other
  misc_feature (141)..(141): n is a, c, g, or t
  modified_base (234)..(234): a, c, t, g, unknown or other
  misc_feature (234)..(234): n is a, c, g, or t
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (489)..(489): a, c, t, g, unknown or other
  misc_feature (489)..(489): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcttaataagtatgtctcatggtaccgnagaacccaggcaaacgcccccaagtcgttctctangatgtcactaagcggccctcaggagtccctgatcgattcnctgctcaagtctggcaacacggcccctcctagaacatctctgggctccgaggctgagatgaggctagattatattgnttgcctnatatcggtaaagtaccttactcttttcgtctttacggaacttgggacccacggtcctaccgtcctaagtccacgccccaaagggccccaaaccccncgttacgtccaacttcttccgtttccccaacccgttctccgtactcgttcttcgccttaaggg

SEQ ID NO: 340663 - DNA, 666 bp, Homo sapiens
  misc_feature: GZ8MTXP01CXGQM.11.59.F04.1.454.CMB.2.raw
  modified_base (140)..(140): a, c, t, g, unknown or other
  misc_feature (140)..(140): n is a, c, g, or t
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
tcagcgagagataccacgaccggtgctcgatttagtacacacacttagggattggggggctttgcctgggctctgctcctcctcagcctcctcactcagggcacaggatcctgggctcagtctgcctgactcagccccgntcagtgtccggtctccgtgggcagtcagtcaccatcccctgcactggaaccagcaatgtatggttgtacgttaataagtntgtctacagtcggaccgacagaacccaggaccaaacgcccccaagtcgtctctangatcgtacacgtaacgccgccctagaggtacctccgtanactcgtacttcgtcgtcgtacctaccgtaagtcgtacggacctaaccgaccggtccccctacctagaacctatccgtcgtacgggccttaccgaggtctaggagtagtggacgttnttagtaattagttgtgcgtacgtactagtagttagtacgttaccttacttacctttacggtttcgttacgttacggaacgtaccggtaacccgtacggtacctaccggtacgtacggtaccaaccgtaccgaaacccgaccccttaaaccgtacgttcgttaccctaccgttcccgttacccgttaccccctcccttacgttaaccgttaccttccgttaccgttccgcggtaacg

SEQ ID NO: 340664 - DNA, 554 bp, Homo sapiens
  misc_feature: GZ8MTXP01BWLRA.11.59.F04.1.454.CMB.2.raw
  modified_base (449)..(449): a, c, t, g, unknown or other
  misc_feature (449)..(449): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtcttatagtatgtctcatggtaccggcacgaacccaggacaaacgcccccaagtccgttctctatgatgtcactaacgcggccctgacggactccctgactcgtattcgtctggacctcaagtctggaccaacgaccggcctacccgtagaactatctacgtcgggcctcgaggctggaggatcgaggctagtattattagtgactgctntatatggtaacttcttacttctttctcgttacggaacttcgggaacctcggttccgaccgttccgtaaggtccaacgccccgaaggaccccaacccgttgttccg

SEQ ID NO: 340665 - DNA, 648 bp, Homo sapiens
  misc_feature: GZ8MTXP01CT64H.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccggtctccgtggcagtcagtcaccatccctgcactggaaccagcaatgatgttggtcttataagtatgtctcatggtaccggacacgaacccaggaccaaacgcccccaaagtcgttctctatgatgtacactaagccggccctcaggacgtccctgactcgattctctcggacctccaagtcctagggccaaacgaccgggccctcccgtagaaccacttcctctcgggctacccgaggccgttggacggagtgaaggtcttaggtatttagtttaagtttgccgttgtacttctagttaacgttacgggtaaacgttacccttaacctttctttttccgttccgtttacgggtaaaccgttcggggtaacccgtacgggttacccgttacccggtttaccgtaacggggttacccaaccggggtacccctaaaaccggggccccaaaccccgttaacccgttccg

SEQ ID NO: 340666 - DNA, 648 bp, Homo sapiens
  misc_feature: GZ8MTXP01EN01R.11.59.F04.1.454.CMB.2.raw
  modified_base (141)..(141): a, c, t, g, unknown or other
  misc_feature (141)..(141): n is a, c, g, or t
  modified_base (279)..(279): a, c, t, g, unknown or other
  misc_feature (279)..(279): n is a, c, g, or t
  modified_base (365)..(365): a, c, t, g, unknown or other
  misc_feature (365)..(365): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctccgtgggcagtcagtcaccatcccctgcactggaaccagcaatgattgttggtcgttaataagtatgtctcagtcggtaccgcaacgaacccaggaccaaaccgcccccaagtcgttctctangatgtacactaagccgcctagaggacgtccctgatcgtattctcgtggcctacaagtctaggacaacgccgcccctcctagaactntccgtcgtcgggctccgaggctaggagtagtgaggtcttagtatttattattgcttgtacttacaagttagtacggtaactttacctttaccgttttcgttttcgttacgttaccgggtaacgtcgggacccgtaccggttaccgtacccgttccgtaacggtcccaaccggccccgtaaacggcccccttaaacccgtacgttccgtacccgtacctttcccgttcccgttaccccctccccttaccttccgttaactcccgttccgttccgttcgttcggg

SEQ ID NO: 340667 - DNA, 688 bp, Homo sapiens
  misc_feature: GZ8MTXP01A92G7.11.59.F04.1.454.CMB.2.raw
  modified_base (172)..(172): a, c, t, g, unknown or other
  misc_feature (172)..(172): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccggtctcctgggcagtcagtcaccatcccctgcactggaaccagcaatgatgttggtcttataagtatgtctcagtcggtaccggcacgaaacccaggaccaaaccgcccccctaagtcgttctctatgatgtcactaacgccggtcctcgaggcgtccctgacctcgtattctctggacctccgaagtctacggaccaacgaccggtccctccgtagaaacctcttccgtcgttcgggaccttacccggaagggtccgttagggaacgggtattagggtaacggtccgtttaggttaactttttaagtttagtttcggtccttaggtccccttacgtaacgttaaggttacgggttaaaacgtttacccctttaacgttttccctttttaacgtacggtttaccggggtaaacgtttcgggggaacccctacgggttcccgttacccggtttaccgtaacgggttccaaccggtccccaagggaccccctaaaccccgttgttcccg

SEQ ID NO: 340668 - DNA, 752 bp, Homo sapiens
  misc_feature: GZ8MTXP01ANFQF.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtacttataagtatgtctcagtggtaccggcacgaacccaggaccaaaccgccccccaagtccgttctctatgatgtcaactaacggccggtccctacgaggtacgtccctgtacctcgatttctcgtcggacctccgtaagtcgtcgggaccaaaccgaccgggtccctaccccgtagaaacctacgttccgttccggtcggggacccttacccggaacgggtcctagggaacgggtagttacgggaacggggtcctttaaggttaacgtttttaatttaacgtttcgtaccgttaggtcccttaacgtaacgttaaaggttacgggtaaaaccgtttacccctttaaccttttcccgtttttaaccgtacccggttttaccggggtaaaccgttcgggggtaaacccctaacccggggttacccgttaaccccgggtttcccgtaacggggttacccctaaccggaccccccgtaaacggggacccccctaaaaccccgttcgtttaacccgg

SEQ ID NO: 340669 - DNA, 621 bp, Homo sapiens
  misc_feature: GZ8MTXP01DKJ24.11.59.F04.1.454.CMB.2.raw
  modified_base (308)..(308): a, c, t, g, unknown or other
  misc_feature (308)..(308): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtcaccatcccctgcactggaaccagcaaatgattgttggtcgttaataagtatgtctcagtggtaccgcagaacccaggacaaacgcccccaagtcgtctctangatgtacactaagccgcctagagacgtcccagtactcgtattcgtactcggtacctccaagtctacgggacccaaacgccggtccctacctagaactactctcgtcgggcctccgaggtctggagagtcgagctagtatttattagttcgcgtcgtctacgagttacgtacggtaacgttaccctttacttccttttccgtacgttaccgggtaacgttccggggtaaaccgtcgggttacccgttccggttaccgtaacggtaccctaaccggaccccgtaacgggttaccccctaacccggttctaacccg

SEQ ID NO: 340670 - DNA, 659 bp, Homo sapiens
  misc_feature: GZ8MTXP01ACVO9.11.59.F04.1.454.CMB.2.raw
  modified_base (411)..(411): a, c, t, g, unknown or other
  misc_feature (411)..(411): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatgttggtcttataagtatgtctcagtcggtaccggcacgaacccaggaccaaacgcccccaagtccgttctctatgatgtacactaagccggcctcgacggcgtccctgacttcgattctctcggtacctccgtaagtcctagggaccaaccgaccgggtcccttaccctagaaacctnttcctcgtcgggccttcccgaagggtccgtaggacgggtattgggaacggtcgttaggtaattttaagttagtttggccttagccttacaagttaagtacgggtaaacttacccttaactttccttttaaccgtccgtttacgggaaaccttcggggtaacccgtaaccgggttcccttacccggttccgttaacggggtccaaccgggtaccccgaacggttcccctaaaccccgttcgttaacccg

SEQ ID NO: 340671 - DNA, 619 bp, Homo sapiens
  misc_feature: GZ8MTXP01CXW8J.11.59.F04.1.454.CMB.2.raw
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (347)..(347): a, c, t, g, unknown or other
  misc_feature (347)..(347): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccactcccctgcactcggaaccagcaatgatgttggtacttaataagtatgtctnagnggtaccgcaacgaacccaggaccaaaccgcccccaagtcgttctactatgatgtacaacgtaagccggccctagaggtactcccngacctcgattctcgtggcctacaagtctggaccaaccgaccggtcctacccagaacctatccgtcgtcgggcctaccggagtcgtaggaggatcggagcttagtatttattactgactgtctatagttacgtacggtaaccttaccttactttccgttttcgtccgttacgggtacgttacggggtaaccctacggttacccgttccgttaccgttaacgggtacccaaccgggacccctaaacccggcccctaaacccgttcgttaacccg

SEQ ID NO: 340672 - DNA, 694 bp, Homo sapiens
  misc_feature: GZ8MTXP01BIWGS.11.59.F04.1.454.CMB.2.raw
  modified_base (257)..(257): a, c, t, g, unknown or other
  misc_feature (257)..(257): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtgtccgggtctccgtgggcagtcagtcaccactcccctgcactggaaccagcaatgatgttggtcttatagtatgtctnatcggtaccgcacgaacccaggaccaaacgccccccaagtccgttctactatgatcgtacaacgtaacgccggtcctcgacggtacgtccctgtacctccgtattccgtctcggtacctaccgtaagtcctacgggaccctaaaccgaccgggtccctacccgtagtaaacctcgttccgtcggtcgggccttacccggaggtccgttaggacgggtatgggaacgtacgttaggttaatttagtttacgttcgtccttgccttataagttacgttagggttaaaccttacctttaccgtttcttttccgttaccggtttaccgggtaaaccgttaccggggtaacccgtaaccggttccccgttaccgttacccggtaaggttacccgaaccgtaccccgaaccgggttacccccaaaaccccgttcgttaacccg

SEQ ID NO: 340673 - DNA, 686 bp, Homo sapiens
  misc_feature: GZ8MTXP01EZXTF.11.59.F04.1.454.CMB.2.raw
  modified_base (680)..(680): a, c, t, g, unknown or other
  misc_feature (680)..(680): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgcactggaaccagcaatgattgttggtacgttaataagtatgtctcagtcggtaccgcaacgaacccaggaccaaaccgccccctaagttccgttctactatgatcgtacaacgtaacggccggtccctacgacggtaccgtccccgtagtaccgtccgtatttccgtcgtcggtaacccttaccgtaacgttccgtacgggacccaaaccgtacccgggtccctaccgtagaacctagtccgtcgtcgggccttaccggaggtcgtagggacggtagtcggaggtctaggttaagttttatttagtcgacgttcgtcgttactaagtacggttaacggtaacgtttaacccttcgttttcgtttctttacggttacgggaaacgttccgggaacccgtaccgggttccttacccggttcggtaacggccaaccgaacccgacccggacccctaaaccccgttnttcccg

SEQ ID NO: 340674 - DNA, 550 bp, Homo sapiens
  misc_feature: GZ8MTXP01DCMU3.11.59.F04.1.454.CMB.2.raw
  modified_base (224)..(224): a, c, t, g, unknown or other
  misc_feature (224)..(224): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (518)..(518): a, c, t, g, unknown or other
  misc_feature (518)..(518): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcaggtgtccgggtctcctgggcagtcagtcaccatcccctgcactggaacngcaatgtatgttggtcgttataagtatgtctcatggtaccggcacgaacccaggacaaacgacccccaacgtacgttctctatgatgtacactaacgcggccctacacggagtccctcgtatccgtatctcgtcggcctccaagtctcggaccgaacaccgcctccctagacactctctcgggctcaggctgagngtgagctntagttattgttagctgntcatagtgtagttactacgttctttctcgttcggtaacgttcggtaccacggttcgccgttacctaagggtacnccgtacccgacggacccctaacccgaacgtcg

SEQ ID NO: 340675 - DNA, 576 bp, Homo sapiens
  misc_feature: GZ8MTXP01A3Z8K.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgattcagccccgctcagtgtccgggtctcctgggcagtcagtcaccatcccctgcactggaaccagcaatgatgttggtcgttataagtatgtctcatggtaccggcagaacccaggaccaaacgccccccaagtcgtctctatgatgtcactaagccggcctcgaggacgtccctgactcgtattctctggacctccgaagtctgggaccaacgaccggcctccctagaaccatccgtcgtcgggacctccgacggctaggagggatggaaggtcttagtagtttatttagttgcgttgctacattagtggtaaactcccttacttctttctcgttacggaaacttgggaccctcggttccgttaccgttccgtaaggtccaacgccccaacggacccctaaccccttcgtaaccg

SEQ ID NO: 340676 - DNA, 663 bp, Homo sapiens
  misc_feature: GZ8MTXP01EQAE4.11.59.F04.1.454.CMB.2.raw
  modified_base (259)..(259): a, c, t, g, unknown or other
  misc_feature (259)..(259): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgcactggaaccagcaatgattgttggtacttatagtatgtctnagtcggtaccgcacgaaccgaggaccaaaccgcccccaagttcgttctctatgatgtacacgtaacgccggcctgacgtacgtcctgtactcgtacttcgtcgtcggtacctaccgtaagtcgtacgggaccaaccgtacccggtcctacccgtagaacctgttccgtcgtcgggtcctaccggaacgggtctaggaggtacgtggaaggtcttaggttaattttagtttagtttcgccgttaggtaccttagtaagttaccgttagggtaaacccttaccctttacgtttcttttcgttaccggttacgggtaacgttcgggaaccccgtacggttacccgttccggttaccgtaacggtccgaaccgtacccgaaccgacccctaaccccgttgttaacccg

SEQ ID NO: 340677 - DNA, 646 bp, Homo sapiens
  misc_feature: GZ8MTXP01DMUNH.11.59.F04.1.454.CMB.2.raw
  modified_base (583)..(583): a, c, t, g, unknown or other
  misc_feature (583)..(583): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcaggtcgtcccgggtctccgtgggcagtcagtccaccactccccctgccacgtacggaaccagacaaagtgtagttggtttagggtacgtttaataagtatggtctacagtcgggtaccggacaacgaacccgaggaccaaacccgcccccctaaggttccttctactatgactcgtacaacgtacggccgcctagacggtcgtccctagacctcgtattctctcgacctcaagtcgtgaccacgccgcctcagactatcgtcgtcggctcgagtctaggagtcgagagtcttagttaatttacttagttcgctcgtacctagtaagttagtaacggtaaaccttacctttactttccgttttcgtccgttaccgggtaacgttcggggtaaccctaccgggttcccnccgttaccggtaacggtaccaaccggaccccgaacggttacccctaaacccgttgttaacccg

SEQ ID NO: 340678 - DNA, 652 bp, Homo sapiens
  misc_feature: GZ8MTXP01BFHPH.11.59.F04.1.454.CMB.2.raw
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcagtcgtcccgggtctccgtggcagtcagtccaccactcccctgcactggaaccagcaatgatgttggtacttatagtatgtctcagtggtaccgcaacgaacccgaggaccaaaccgccccctaagtccgtctctatgatcgtacacgtaacgccggccctagacggtactccctgacctcgtattccncgtcggacctaccaagtctacggacaaccgccggtccctaccgtacgaactntccgtcgcggtcctccgaggtctaggaggcgtggaacgtcgttagttaatttagtttagtcggtacttacgtcctagtaacgttaagttacggttaaaccgtttcccttactttcccttttaacgtaccggtttaccggaaccggttccgggtaacccgtaacccggttcccgttacccgttccggtaacgcccgaaccgtacccaacccggttcccctaaacccttcgtaaccg

SEQ ID NO: 340679 - DNA, 683 bp, Homo sapiens
  misc_feature: GZ8MTXP01B2G6Y.11.59.F04.1.454.CMB.2.raw
  modified_base (173)..(173): a, c, t, g, unknown or other
  misc_feature (173)..(173): n is a, c, g, or t
  modified_base (464)..(464): a, c, t, g, unknown or other
  misc_feature (464)..(464): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgntcagtcgtccgggtctcctgggcagtcagtcaccactccctgcactggaaccagcaatgatgttggtcttaataagtatgtctcagtcggtaccgacacgaacccaggaccaaacgcccccaagtccgttctactatgtatcgtacaacgtaacgcccggacctacgacggtacgtccctaggtaccttccggtactttccgtctcggtaaccttaccaaggtctacgggacaaccgaccggccctacctagaaccattcctcgtcgggcctcggaacggtctaggaaggntagggaggtacttaggtaatttaagtttagttcggtcttcggtacctacgtaagttagtacgggttaaaccttaccctttactttccgtttttcgttacccgtttacggggtaaccgttcgggtaaacccgtacccggtttacccgaccccggtttacccgtaacgggttccaaccggttaccccgaacggttaccccctaaccccgttaacgttcccg

SEQ ID NO: 340680 - DNA, 611 bp, Homo sapiens
  misc_feature: GZ8MTXP01ATEWF.11.59.F04.1.454.CMB.2.raw
  modified_base (477)..(477): a, c, t, g, unknown or other
  misc_feature (477)..(477): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccatcccctgcactggaaccagcaatgatgttggtcgttataagtatgtctcatggtaccggcaacgaacccaggaccaaacgcccccctaagtccgttctctatgatgtcacgtaagccgcctgaggtactccctgactcgtattctcgtggacctaccgtaagtcctagggaccaaccgaccggtccctaccctagaacctattccgtcgtcggggccttaccgagggcgtaggaggtactggaggtctagtagtttattagtgctgcctnattagtcggtaacttaccttacttcttttcgtcgtttcgggaaacgttcggggtaaccctacgggttccttacccggttccgttaagggcccaacggacccccgtaaacggacccctaaaccccgaacgttccg

SEQ ID NO: 340681 - DNA, 690 bp, Homo sapiens
  misc_feature: GZ8MTXP01D76JS.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctcgccctgactcacgccccgctcagtcgtccggtctccgtggcagtcagtccaccactcccctgcactacggaaccagacaatgtagttggttggtacttaagtaagtatgtctctagtcggtacgacaacgaacccgaggaccaaaccgccccctaagttccttctactagtgtatcgtacacgtacggccgtccctagacggtactcccgtagacctcgtattccgtcgtcggacctaccgtaagtcgtacggacccaaccgtcccgggtccctacgtaacgaacctctccgtaccggtcgggtccttaccggaacgggtccgtaggggaaggtacgtagggtaaccgggtactttaggttaaattttagtttagggttcggtacgtactacgtaagttaagttacggtaaacttaccctttactttcctttccgtaacgttacgggaaccggtcggaaccgtaccgttcccgttaccgttccgttacggtaaccaccgtaacccgaaccgccccaaccgtcttaacgtaaccc

SEQ ID NO: 340682 - DNA, 557 bp, Homo sapiens
  misc_feature: GZ8MTXP01A1HQN.11.59.F04.1.454.CMB.2.raw
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (555)..(555): a, c, t, g, unknown or other
  misc_feature (555)..(555): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtcttataagtatgtctnatggtaccgnagaacccaggaccaaacgcccccaagtccgtctctatgatgtcacgtaagccgtcctgacggactccctgactcgtattctcgtggacctccgtaagtctacgggccaaacgtccggcctccctagaacatcctcgtcggcttccgaggtctggacggatcgaggtctagtatttaagtttntgcgtnctanagtagtacgtaacttaccttcttctttaactcgttacggacgttcggaaccgtacgttccgaccgttcgtaacgcaaccgaccacgaccaacgttcncg

SEQ ID NO: 340683 - DNA, 662 bp, Homo sapiens
  misc_feature: GZ8MTXP01EXMLR.11.59.F04.1.454.CMB.2.raw
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtggcagtcagtcaccactcccctgacaagtcggaaccagacaatgtattgttggtacgttaataagtatgtctcagtcggtaccgacaacgaaccgaggacaaaccgccccctaagtcgttctctatgatgtacacgtaacgccgcctagacggactcctagactcgtattctcgtcgacctacctaagtcgtacgggaccaaccgaccggtccctaccgtagaactacgttcgtcggtacgggtcctacggaaggtcgtaggaggtacgtcggaggtactaggttaatttagtttagttcggactcgtacttacgtaagttaacgtacggtaaacctttacccttacttttccgttttaacgtaccgtttacgggaaccgttacgggaccctaccggttaccgttaccggttaccgtaacggtaccaaccggaccccgaacggacccctaaacccgttcgtaacccg

SEQ ID NO: 340684 - DNA, 645 bp, Homo sapiens
  misc_feature: GZ8MTXP01C7LI5.11.59.F04.1.454.CMB.2.raw
  modified_base (637)..(637): a, c, t, g, unknown or other
  misc_feature (637)..(637): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtccaccactcccctgcacgtcggaaccagcaatgtatgttggtacgttaataagtatgtctcagtcggtaccggcaacgaaacccaggaccaaaccgccccctaagtcgttctctatgtatgtacactacgccgcctagacggactcctagtactcgtattcgtctcggtacctaccgaagtctcggaccaaaccgcccggtcctacccagaactctctcgtcgggcctccgaggtcgtaggacggtatgggacggtacttaggttaattttagtttacgttgacgttgtcctagtaattaaggttacggtaaacctttcccttacttttcgttttccgtcgttacgggaaccgttcggggtaaaccctcggggttaccttcccggttcgtaacgggccaaccggtaaccccgaacggacccctaaaccccgttnttaacccg

SEQ ID NO: 340685 - DNA, 838 bp, Homo sapiens
  misc_feature: GZ8MTXP01DL2UQ.11.59.F04.1.454.CMB.2.raw
tcagcgagagataccacgaccggtgctcgatttagtacacacacttaggggctggggtctcaggaggcagcactctcgggacgtctccaccatggcctgggctctgcctcctcctcagcctcctcactcagggcacaggatcctgggctcagtctgccctgactcacgccccgctcagtcgtccgggtctccgtgggcagtcagtccaccactcccctgcactggaaccagcaatgtatgttggtcgttaatagtatgtctcagtcggtaccgcaacgaacccaggaccaaaccgccccctaagttccgttctactagtgtacttgtacaacgtaacggcccggtccctacgacggtactccccgtgaccttcggtactttccgtcgtcggaaccttaccgaaggttccgtacgggaccaaacccgtcccgggtaccccttacccgtaagaacctacttccgtaccggttcggggtaccttacccggaagggtccgttaaggggaacgggtagttacgggaacgggttaccgttaaggtttaaagttttttaaccgttttaaggtttaccggtacccggttcgttaacccttacgttaaagtttaaacggttaaccgggttaaaacccggttttacccctttaacttttttcccgtttttaacccggtacccggttttaaccgggggtaaaacccgttcccgggggttaaaccccgttaacccggggtttaccccgttaccccgggtttaacccggttaacgggggtaaccccaaccccggggttaaaccccaaacccggggttaacccccctaaacccccggttctttaaccccggg

SEQ ID NO: 340686 - DNA, 680 bp, Homo sapiens
  misc_feature: GZ8MTXP01D4C5D.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtcttaataagtatgtctcagtcggtaccggcaacgaacccaggaccaaaccgcccccaagtccgttctctatgatgtacactaacgcggcctgagactcctgactcgattctctcggacctcaagtctacggaccaacgaccggtcctaccgtagaacctatctcgtcgggcctaccgagggtctagggacggatacggaggtacttaggtaagtttaactttagttggtaccttggacccttacgtaagttaaggttacgggtaaaccgtttaccctttacgtttccctttttaaccgttaccgtttaccggggtaaaccggtttccgggggtaaaccccttaacggggttccccgttacccggtttacccgtaacggggttcccaaccggggtaacccccaaaccgggttacccctaaacccccgttcggtttaacccg

SEQ ID NO: 340687 - DNA, 597 bp, Homo sapiens
  misc_feature: GZ8MTXP01AQYHI.11.59.F04.1.454.CMB.2.raw
  modified_base (389)..(389): a, c, t, g, unknown or other
  misc_feature (389)..(389): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcttataagtatgtctcatggtaccggcagaacccaggaccaaacgccccccaagtccgttctctatgatgtcactaagccggccctgaggacgtccctgactcgtattctctggcctccaagtctggacaacaccggcctccctagaacctntcctcgtgggcctccgagggctaggaggactggagggtcttagtacgtttattaattgcgtgtctacattagtacggtaacttacccttactttcttttcctcgtttccgggaaacgttcggggaacccctacgggttcccttacccggttccgtaacgggtccaaccggccccgtaaacgggccccctaaaccccgttcgttcccgg

SEQ ID NO: 340688 - DNA, 579 bp, Homo sapiens
  misc_feature: GZ8MTXP01AOCHG.11.59.F04.1.454.CMB.2.raw
  modified_base (384)..(384): a, c, t, g, unknown or other
  misc_feature (384)..(384): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcagtggtaccggcacgaacccaggaccaaacgcccccctaagtcgttctctatgatgtcactaagccgcctgagacccccgtctgactcgattctctggctcaagtctggcacgccgcctccctagaacnctcgtctcgggcctccagggctaggaggagtggaggcttgtaatttagttacgttgcttgtctacgtaagttacgtaggtaaacgttacccttactttcttttcctcgtttacggaaacgttcgggtaaccctacggttccgttccgttccgtaacggtccaacggtccccacggacccctaacccgcttaaccg

SEQ ID NO: 340689 - DNA, 552 bp, Homo sapiens
  misc_feature: GZ8MTXP01CC1PN.11.59.F04.1.454.CMB.2.raw
  modified_base (317)..(317): a, c, t, g, unknown or other
  misc_feature (317)..(317): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccggtctcctggcagtcagtcacatcccctgcactggaaccagcaatgatgtggtcttatagtatgtctcatggtacggcagaacccaggacaaacgcccccaagtcgttctctatgatgtacactaagcggccctnagacgtccctgactcgattctcgtcggctccaagtctgggaccaacaccggtcctacccgtagaacctacgtctcgtgggacctaccgaggctgacgatggagtctgtaattattacgttgacttgcttcattacgtggtaacttacttacttctttcgtcttcgggaaacttcgggaaactccgacgttccgttcttaacggacaacgcccacggttacccaaccccgttgtcg

SEQ ID NO: 340690 - DNA, 697 bp, Homo sapiens
  misc_feature: GZ8MTXP01CBD5E.11.59.F04.1.454.CMB.2.raw
  modified_base (269)..(269): a, c, t, g, unknown or other
  misc_feature (269)..(269): n is a, c, g, or t
tcagcgagagataccacgaccggtgctcgatttagtacacacacttaggggctggggtctcaggaggcagcactctcgggacgtctccaccatggcctgggctctgctcctcctcggcctcctcactcagggcacaggatcctgggctcagtctgccctgactcacgccccgctcagtcgtccgggtctccgtgggcagtcagtcaccactcccctgcactggaaccagcaatgatggttggtcttaataagtatgtctcatggaccgnacgaaccaggacaaacgcccccaagttcgtctctatgatgtacacgtaacgcccggtccctacgacggtacgtcctagacttccgtatttcgtcgtcggaccctaacccgtaaggttccgtacgggtaacccaaacccgtaccgggtccccttaccccgtagaaaccctacgttccgttccggtcggggtacccttaccggaagggtccgttagggacggtagtggacgggtcttagtacttttaagtttacgttcgtctcgtcttaacgtagttaacggttagggtaaactttacccttaacttttccgttttcttaaccggttaacggttaacggttccggggaacctaccgggtccttacccggttcgttaacggtccgaaccgaacccgaaccggtaccccttaaacccgtcgttcgtaacccg

SEQ ID NO: 340691 - DNA, 571 bp, Homo sapiens
  misc_feature: GZ8MTXP01CS8GV.11.59.F04.1.454.CMB.2.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatgttggtcgttaataagtntgtctcagtggtaccggcagaacccaggaccaaacgcccccaagtccgttctctangatgtcactaagccgcctcaggactccctgactcgattctctggctccaagtctaggcaacacggccctcctagaacatctcgtgggcctcgaggctaggaggangacgtctgtagtttattagttncttcgcttacgagtagtcggtaaacgttcctactttcttttcctcgttacggaaccgttgggaaccctcggttaccttccggttccgtaacgggtaccaaccggtaccccaacgggttaccccaacccgttcgtccg

SEQ ID NO: 340692 - DNA, 551 bp, Homo sapiens
  misc_feature: GZ8MTXP01BVYOL.11.59.F04.1.454.CMB.2.raw
  modified_base (386)..(386): a, c, t, g, unknown or other
  misc_feature (386)..(386): n is a, c, g, or t
  modified_base (438)..(438): a, c, t, g, unknown or other
  misc_feature (438)..(438): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
  modified_base (547)..(547): a, c, t, g, unknown or other
  misc_feature (547)..(547): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccggtctcctggcagtcagtcaccatcccctgcactggaaccagcaatgatgttggtcgttatagtatgtctcatggtacgcagaacccgaggccaaacgccccccaagtcgttctctatgatgtcactaacgccgcctgacgacgtccctgactcgtattctctggacttaccaagtctcggacaacgaccggcctaccctgaacntctcgtcgggcctccgaggctagaggatcgaggctgattattatgctgcctnatagtgtaacgttaccttacgttcttttcncgtttacggaacgttcgggaacccncggttccttaccgttccctaagggtcccaacgaccccacggacccctaacccgntccg

SEQ ID NO: 340693 - DNA, 705 bp, Homo sapiens
  misc_feature: GZ8MTXP01E0N8C.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctccgtggcagtcagtcaccatcccctgcactggaaccagcaatgatgttggtcgttataagtatgtctcagtggtaccggcaacgaacccaggaccaaaccgcccccctaagtcgttctctatgatgtcaacgtaacgccggtccctcgacggacgtcccctgacttcgtattcctcgtcggtaccctaccgaagttcctacgggaccaaaccgtccgggtccccttacccctacggaaacctacttccgtccggtacggggcccttacccgaacgggtccgtagggaacgggtagttcgggaacgggtctaggtaatttagtttagttgggtcgtcttacaattacgttacgggtaaacgttacccttacctttcgttttaccgtcgtttaccgggttaaaccgttccgggggaaccctaaccgggttccccttaacccgggtttccgaacggggttcccaaccgggtaacccccgaaaccgggtcccccaaaacccccgtcgttaacggttccccg

SEQ ID NO: 340694 - DNA, 746 bp, Homo sapiens
  misc_feature: GZ8MTXP01A8YYO.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcaggtgtccgggtctccgtgggcagtcagtcaccactcccctgcactggaaccagcaatgatggttggtacgttataagtatgtctcagtcggtaccggcaacgaaacccgaacggaaaccgcccccctaagttccgttctctatgatgtacacgtacgccgaccctcgaggtcgtccctgactccgtatttctcgtcggtcctaaccgaacgttcgtacggacctaaaccgtaccggtcccctacccgtagaaaccctacgttccgttccggtcggggtacctacccgtaggggaccgttaggggaaggtacgtagggtaacggtcttaagtttaatttacggtttacgttcgtcttcgtaccttacgtaagtttacggtaacgggtaaaccgtttacccttaaccgtttttccgttttacccgttaaccggtttaccgggttaaaccgggttacggggttaaccccgtaacccgggtttcccttaaccccgggtttcttaccggggtaaccctaccgggaacccccgtaaaccgggacccccttaaaccccgtaacgttccggtaaccc

SEQ ID NO: 340695 - DNA, 670 bp, Homo sapiens
  misc_feature: GZ8MTXP01AMJRK.11.59.F04.1.454.CMB.2.raw
tcagcgagagataccacgaccggtgctcgatttagtacacacacttaggggcttgggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgatgttggtcgttataagtatgtctcagtcggtaccgcacgaacccaggacaaaccgcccccaagtcgttactctatgatgtacactaacgccgcctagacggacgtccctgtacctcgtattctcgtggacctcgaagtcgtacggaccaaccgaccggtccctaccctacgaaccctacgttccgtcggtcggggcccttaccggaacgggtccttagggtaacgggagttacgggacggtacttaggttaacgtttatttacgtttcgacttcgtcttactagttaacgtacgggtaaccttaccctttactttccgttttaacctacggtttacggtaaaccgttcgggtaaccctacgggttcccgttaccggttccgtaagggtaccaaccgggaccccaaacgggacccctaaaccccttcggttaacccg

SEQ ID NO: 340696 - DNA, 674 bp, Homo sapiens
  misc_feature: GZ8MTXP01ENHQ8.11.59.F04.1.454.CMB.2.raw
  modified_base (141)..(141): a, c, t, g, unknown or other
  misc_feature (141)..(141): n is a, c, g, or t
  modified_base (237)..(237): a, c, t, g, unknown or other
  misc_feature (237)..(237): n is a, c, g, or t
  modified_base (275)..(275): a, c, t, g, unknown or other
  misc_feature (275)..(275): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccactcccctgcactggaaccagcaatgatgttggtacgttataagtatgtctcagtggtaccgnacgaacccaggaccaaacgcccctaagtcgttctctangatgtacacgtacgccgcctgaggacgtccctgactcgtacttctcgtcggccttaccgtaaggttccgtacggaccaaaccgacccggtccccctacccctagaacctactccgtaccgtcgggtcctccgaagggtcctagggacggtagtcgggaggtcgtagtatttaagttagttcgtcttagtcttactagtaacgtacggtaacttaccttacgttttcgttttccgtacggttaccgtaacggtaccggtacccgtaccggtaccgtacccgttaccgtacggtaccaccgtacccgaaacccgtacccttaaaccccgtcgttaccgtaccctacttcccgttccgttcccccgtccctcccgttcctactcccttcgtccgttcgtcgg

SEQ ID NO: 340697 - DNA, 688 bp, Homo sapiens
  misc_feature: GZ8MTXP01DXFBY.11.59.F04.1.454.CMB.2.raw
  modified_base (432)..(432): a, c, t, g, unknown or other
  misc_feature (432)..(432): n is a, c, g, or t
  modified_base (467)..(467): a, c, t, g, unknown or other
  misc_feature (467)..(467): n is a, c, g, or t
tcagcgagagataccacgaccggtgctcgatttagtacacacacttaggggctggggtctcaggaggcagcactctcgggacgtctccaccatggcctgggctctgcctcctcctcagcctcctcactcagggcacaggatccgtgggctcagtctgccctgactcacgccccgctcagtgtcccgggtctccgtgggcagtcagtccaccactccccctgccacgtcggaaaccagacaatgtattggttaggtacgttaataagtatgtctcagtcggtaccgcaacgaaacccaggaccaaacccggccccctaagtccgttctctatgtatcgtacactaacgccgcctgacggtactcctagactcgtattcgtctggcccttacgaagtcgtaggacccaacgcccggtcctacccgtagaacctntccgtcgcgggtcctaccgaggtccgtaggaggangacggactttaggtaaattttagttagtttcggaccttgtccttataacgttaagtccgggtaaacctttaacccttccttttccgtttttaaccgtcggtttaccgggtaaacccgttccggggtaaacccctacgggtttacccacccgggtttaccgtaacggtacccaaccgacccccgtaaacgggaccccctaaaccccgttccgtttaacccgg

SEQ ID NO: 340698 - DNA, 696 bp, Homo sapiens
  misc_feature: GZ8MTXP01EV9MN.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgcccccgctcagtcgtccgggtctcctgggcagtcagtccaccactcccctgcactggaaccagcaatgattgttggtacttaataagtatgtctcagtggtaccggcacgaacccaggaccaaaccgccccccaagtccgttctctatgatgtacactaacgccgtcctcgacggctccctgacctcgtattctcgtcgacctacgaagtctcgggacccaaccgtaccgggtccctcccgagtaacctacttccgtcggtcgggtccctcggaagggtccgttagggaacggtagtcgggaacggtcttaggttaactttagttttaagtttcgaccgtttcgtaccttacgtaagtttaaggttaacgggtaaacctttacccgtttacctttccttttccgttaccgttttaacggggaacccggtttccgggaaacccgtaccgggttacccgttaccccggttccgtaacgggtacccaaccggtacccccgaacggttaccccctaaccccgttaacgttccg

SEQ ID NO: 340699 - DNA, 642 bp, Homo sapiens
  misc_feature: GZ8MTXP01B85X7.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccactccctgcactggaaccagcaatgatgttggtacttaatagtatgtctcagtcggtacgcacgaaccaggaccaaaccgcccccaagtcgttctctatgtatcgtactaacgtaacgccggccctagacggtacgtccctagtacctcggtattcgtcgtcggaccttaccgaagtctacgggaccaaccgaccggtccctaccgtagaacctacgtccgtcgtcgggtccttaccggacgggtccgtaaggacggtagtacgggacggttacgttaggttaacgttttatttacgttcgtcgtacgtactacgtaagttacgtacggtaaacgttaccttactttcgtttaactcgttacggacgttcgggaacctcgttaccgttcgttacgtaacggctaacgacccgtacgaccctaacccgttcgtccg

SEQ ID NO: 340700 - DNA, 624 bp, Homo sapiens
  misc_feature: GZ8MTXP01AFQVH.11.59.F04.1.454.CMB.2.raw
  modified_base (323)..(323): a, c, t, g, unknown or other
  misc_feature (323)..(323): n is a, c, g, or t
tcagcgagagataccacgaccggtgctcgatttagtacacacacttagggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtacttataagtatgtctcatggtaccgcaacgaacccaggcaaacgcccccaagttcgttctctatcgatgtcactagcgcctnacggagtcctgactcgattcgtctggaccttacgaagtcgtcggacaaccgtaccggcctacccctagaaacctacttccgtcgtcgggccttccgaacgggtcctaggacgggtattagggtacttagtaatttagtttattcggtctcggtctacctattacgtacgggtaacttacccgttaactttcctttcgtaacgtacgggttaacgtcgggttaaccgtaccggttcgttacccgttcgttacgggcctaaccggcccctaaacgggccccttaaaccccggtcttcgtcccg

SEQ ID NO: 340701 - DNA, 761 bp, Homo sapiens
  misc_feature: GZ8MTXP01CNL1I.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccactccctgccactcggaaccagacaagtgattgttcggtacgttataagtatgtctcagtcggtaccggcaacgaaccgacggaccaaaccgccccctaagtccttactctatacgtacttcgtaccaacgtacggcccggccctacgacggtacgttcctaggaccttcggtactttccgtcgtacggtaccttaccgaacgttccgtacgggaccctaacccggtaccgggtcccctacccgtaacggaaccttacgttccgtacggttcgggccctaccggaacggtccgtagggtacggtacgtgggtaacgggtcgtttaaggttaacttttaacgtttacgtttcggtccgttacggtaccttaacgtaagttaacgttaacggggttaaacctttacccgttaaccttttccgttttaaccgttccggttaccgggtaaacggttcccgggtaaacccgtccgggttaacccgttaaccgggttcccggttaacggacccgtaaccggaaccccgaacggttacccctaaaccccgttcgtaacccg

SEQ ID NO: 340702 - DNA, 656 bp, Homo sapiens
  misc_feature: GZ8MTXP01AUQPC.11.59.F04.1.454.CMB.2.raw
  modified_base (173)..(173): a, c, t, g, unknown or other
  misc_feature (173)..(173): n is a, c, g, or t
  modified_base (441)..(441): a, c, t, g, unknown or other
  misc_feature (441)..(441): n is a, c, g, or t
  modified_base (510)..(510): a, c, t, g, unknown or other
  misc_feature (510)..(510): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgntcagtcgtccgggtctccgtgggcagtcagtccaccactcccctgcactggaaccagcaatgattggttggtacgttatagtatgtctcagtcggtaccgcacgaaccaggaccaaaccgccccctaagtccgttctacgtatcgtatcgtacaacgtaacgccggcctacgacggtaccgtccctagacctcgtattccgtcgtcggtaaccttaccgaagttccgtacgggaaccaacccgccggtcccctacccgtagaaacctntccgtcgtcgggcctacgacggtctaggcgtagcggtaggcttagtatttaattagtcgtctgaccgtntaagttacgtacggtaaaccttaccttacctttcttttccgtacgttacgggtaaccgttccgggtaaccctcgggttacccttcccggttacgttaacgggcccaacccggaccccgaaccggacccctaaccccgttgttcccg

SEQ ID NO: 340703 - DNA, 583 bp, Homo sapiens
  misc_feature: GZ8MTXP01A2DF9.11.59.F04.1.454.CMB.2.raw
  modified_base (228)..(228): a, c, t, g, unknown or other
  misc_feature (228)..(228): n is a, c, g, or t
  modified_base (421)..(421): a, c, t, g, unknown or other
  misc_feature (421)..(421): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
tcagcgagagataccacgaccggtgctcgatttagtacacacacttaggggctgggggtctcagggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccatcccctgcactggaaccngcaatgatgttggtcttatagtatgtctcatggtaccggcaacgaacccaggaccaaaccgcccccctaaagtccgttctactagtcgagtcgtacaacgtaacgcccggtcctcgacggacgtccctgactccggattcgtctggtcctaccgaagtctacgggaccaaacgccggtcctccgtagaaactntcctcgtcgggctaccgaggctaggagatgaacggcttagagttaacttntgcgtnctanatagtacgtacttacctacttccttcgtacgttacgacgttcggtaccctacggttccaccgttcgtaacgctaaccgcccgacgacccctaaccgttgtcg

SEQ ID NO: 340704 - DNA, 651 bp, Homo sapiens
  misc_feature: GZ8MTXP01B3HWS.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccatcccctgcacgtggaaccagacaatgattgttggtacgttataagtatgtctcagtcggtaccgcaagaaccccaggaccaaaccgccccccaagttccgttctactatgattcgtacaactaacggcccgtccctacgaggtactccccgtgtaccgtcgtatttctcgtcggaccttccgtaagtctacggacctaaaccgccgggtaccctcccgtagaacctacgttcctcggtcgggccctacgaggtcgtaggagggatcgggagtcgtaggttatttatttacgttgacgtgtcctgtaatagttacggtaaactttaccttactttcttttccgtaacgtttccggaaacgttccgggaacccgtcgggttccttcccgttaccggtaagtacccgtaacgaccccgaacggttcccctaaacccgttcgttccg

SEQ ID NO: 340705 - DNA, 567 bp, Homo sapiens
  misc_feature: GZ8MTXP01BN6QO.11.59.F04.1.454.CMB.2.raw
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtcgttataagtatgtctcatggtaccgcagaacccaggaccaaacgccccccaagtcgttctctatgatgtcactaacgcgccctgaggacgtccctgactcgattcncgtgctcagtctgcaacgcgtcccctcctagaactntctctggctccagctggagntgagctagtatttatatgctgtctacagtagngtaactcgttactttcctttcgttaccgttacggaacgttcgggtaacccacggttaccgtaccgtaccgttaggtaccaccgtcccgaaacggcccttaaaccctcttcgtacctacgttccttccgttccctaacctcttcgtactcgttactcgctaacgg

SEQ ID NO: 340706 - DNA, 756 bp, Homo sapiens
  misc_feature: GZ8MTXP01BOVZ5.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgattgttggtacttaataagtatgtctcagtggtaccgacaacgaaacccaggaccaaaccgcccccaagtccgtctctagtgatgtaccaacgtaacgcccggcccttacgacgggtacgtcccgtagtaaccgttccggtaatttccgtcgtacgggtcccttaacccgaacggttccgtacgggaacctaacccgtacccgggtccccctacccgtaacgaacctacgttcccgttcggtacgggtcccttaccgaacggggtcctaggaacgggtatcggacgggttccttaagggttaactttttaagtttacggttacgtcgttacgtctaaccgtaagttaaacggtttacgggtaaaacccttttccctttaacttttcgtttttaacccgttcgtttaccggggtaaaccgttcggggtaacccccgttacgggttacccgttcccggttacgttaaccgggtccaaccccgggtacccccgaaccgggttaaccccctaaccccttgtttcccg

SEQ ID NO: 340707 - DNA, 693 bp, Homo sapiens
  misc_feature: GZ8MTXP01C77AB.11.59.F04.1.454.CMB.2.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (530)..(530): a, c, t, g, unknown or other
  misc_feature (530)..(530): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccactcccctgcacgtacggaaccagacaatgtattggttggttacgttaataagtntgtctntagtcgtaccgcaacgaacccaggaccaaaccgcccctaagtccgttctctatgatgtaccacgtacggccgcctgacggtacgtcctgtactcgtacttcgtcgtcggacctaccgtaagtccgtacgggaacccaaccgtacccggtcccctaccgtagaaaccttcttccgtcgggtacgggtcccttaccggagggtaccgtagggaaacgggtattacgggaagtcgttagttaatttaagttttcgtggtccgttntacccgttataagtttacggtaacggttaacctttacctttctttcgttttcaaccggtttcgggaaaccgttcggggtaaccctacgggttcccgttcggttaccgtaagggtacccaacccgggtaacccctaacggccccctaaaccgttcgttaacccg

SEQ ID NO: 340708 - DNA, 509 bp, Homo sapiens
  misc_feature: GZ8MTXP01AKH7V.11.59.F04.1.454.CMB.2.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (488)..(488): a, c, t, g, unknown or other
  misc_feature (488)..(488): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtacggcagaacccaggcaaacgccccccaagtcgtctctatgatgtcactaagcggccctcaggagtccctgatcgattctctggctccaagtctggcaacacggcccctcctgaacatctctgggctccagggctgaggatggaggctgaattattatgntgctnatatggaatacctatctttctcttcgaactgggacacggtcacgtcctaggtccagccaaggccaaacccacttgtcacttcgttcgttccccnccctctctctcttctcgcgtg

SEQ ID NO: 340709 - DNA, 659 bp, Homo sapiens
  misc_feature: GZ8MTXP01DSE3V.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagccctcctcactcagggcacaggatccgtgggctcagtctgccctgactcacgccccgctcagtcgtcccgggtctccgtgggcagtcacgtcaccactcccctgacacgtacggaaccagactaatgtattggttggttacgttaataagtatgtctacgagtcggtaccgacaacgaacccgaggaccaaaccgcccctaagtccgttctactatgtatgtacacgtacgccggtcctagacggtacgtcctgtactcggtacttcgtcgtcgtaacctacgtaacgtcgtacgaccaaccgcccggtacccttaccgtacgaactcgttccgtacggtcgggcctacggaggtcttagggagtagtgacgtacgttagttaattttcgttagtcgtcgtcgtaccttgtaagttagtaaccggttacttaccttcttttccgtttaactcggttaccgggtaacgttaccgggtaccgtccgttaccgttccgttacgtaacgtacccaacgtacccgaccaccctaacccgttgttccc

SEQ ID NO: 340710 - DNA, 798 bp, Homo sapiens
  misc_feature: GZ8MTXP01CTBM7.11.59.F04.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccactcccctgcactggaaccagcaatgatgttgtcgttatagtntgtctnanggtacgcagaccaggaccaacgcccccaagtcttctntatgatcgtcacgtaacgccggcccctagacggtacgtccctgaccttcgtatttccgtcgtcgggtacccttacccgaaggttccgtacgggtacccgtaaaccgaccccggggtccccttaccccgttacggaaacccttacgttcccgttaccggttcggggtaccccgttacccgaacgggggttcccggttaaggggaaccggggttaatcgggggtaacggggtcctttaagggttaaacgtttttatttaacggtttcggcccgttaggtcccttaaccgtaagtttaacggttaccggggttaaaacgtttacccctttttaccgtttaccgttttttaacccggtaacccgtttttacgggggaaaccccgttccggggggttaaaccccttaccgggggttaccccgttaccggtttccccgttaaggggttaccccgaaccggtacccccggaaacccgggttaccccctaaacccccggttgtttaaccccg

SEQ ID NO: 340711 - DNA, 609 bp, Homo sapiens
  misc_feature: GZ8MTXP01B42SD.11.59.F04.1.454.CMB.2.raw
  modified_base (605)..(605): a, c, t, g, unknown or other
  misc_feature (605)..(605): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctgggcagtcagtcaccatcccctgcactggaaccagcaatgatgttgtcgttatagtatgtctcagtcggtacgcacgaacccaggacaaacgccccctaagtccgttctactatgatgtacactaacgccggcctacgacggacgtccctagtacttcgtatttcctcgtacggtccttacctaacggttccgtcgggaccaaaccgacccggtccctacccgtacgaacctacttcgtcgtcggggtcctccggaacgggcttaggaggtacgtacggaacggtcgttagtacgtttaatttagttcgcttgtctactagttaacgtagggtaacttaccttacttcttttctcgtttacgacgttcggacctcggttcgaccgttctaagtcaacgccacgccctaaccgngtcg

SEQ ID NO: 340712 - DNA, 716 bp, Homo sapiens
  misc_feature: GZ8MTXP01CPMFF.11.59.F04.1.454.CMB.2.raw
  modified_base (253)..(253): a, c, t, g, unknown or other
  misc_feature (253)..(253): n is a, c, g, or t
tcagcgagagataccacgaccggtgctcgatttagtacacacacttaggggctgggggtctcaggaggcagcactctcgggacgtctccaccatggcctgggctctgctcctcctcagcctcctcactcagggcacaggatccgtgggctcagtctcgccctgactcacgccccgctcagtgtccgggtctccgtggcagtcagtcacactccctgcacgtgaaccagcaatgatgttggtacgttataagtntgtctctagcggtaccgacaacgaccgaggaccaaaccgccccctaagttccgttctactatgacttgtacctaacgtaacgggcccgacccgtacgacgggtacgtccctgtacctcggtacttcgtacgtcggtaaccttaccgaacggttccgtacgggaccaaccggtacccggcccttaccgaacgtaactctcccgttcggtcgggtccctaccgaggggtccttaggaagggacgttagggacggttacgttagtttaaaggttttgtttaagggttcgggttactacccgttagttaagttacggtacgggttaaaccttaacccgtttcttttccgttttacctcgggtttaaccggaacggttcccggggaacccgtaccgggttcccgttacccgttcggttaccgggtcacccggaaccgtacggaccccttaaccgtcgttctaaccccg

SEQ ID NO: 340713 - DNA, 782 bp, Homo sapiens
  misc_feature: GZ8MTXP01CXPLD.11.59.F04.1.454.CMB.2.raw
  modified_base (258)..(258): a, c, t, g, unknown or other
  misc_feature (258)..(258): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgatgttggtcgttaatagtatgtctnagtcggtaccgcacgaacccaggaccaaaccgcccccaagtccgttctctatgatcgtcaacgtacgccggacctagacggtacgtccctagtactcgtacttcgtcgtcggtacccttaccgaagtccgtacgggaccctaaccgtacccgggtccccttacccgtacggtaaaccctacgttcccggtaccggttacgggggtcccttacccgggaaggggtccgttaggggtaacgggtaaggttacgggtaaacgggttccgtttaggtttaaactttttaagtttacgtttacggtacctttcggtacccttagtaaacgtttaacggttaccggggttaaaaccgttttaccctttaaccttttcccgttttttaaccgtaccgttttacccggggtaaaccgttccggggtaaaccccttccggggttaccccgttacccggttacccgtttaacgggtacccgaaccggttaccccggaaccggttaccccctaaaacccccgttcgtttaacccg

SEQ ID NO: 340714 - DNA, 639 bp, Homo sapiens
  misc_feature: GZ8MTXP01BFXF4.11.59.F04.1.454.CMB.2.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (314)..(314): a, c, t, g, unknown or other
  misc_feature (314)..(314): n is a, c, g, or t
  modified_base (461)..(461): a, c, t, g, unknown or other
  misc_feature (461)..(461): n is a, c, g, or t
tcagcgagagataccacgaccggtgctcgatttagtacacacacttaggggctgggggtctcaggaggcagcactctcgggacgtctccaccatggcctgggctctgctcctcctcagccctcctcactcagggcacaggatcctgggctcagtctgccctgactcacgccccgctcaggtcgtccgggtctccgtgggcagtcagtcaccactcccctgccactggaaccagcaatgatgttggtacttanagtatgtctnagtggtaccgacacgaacccaggaccaaaccgcccccaagtcgttctcatgntgtacacgtacgccgcctacgaggactccctgactcgtattcgtcgtcggcctacaagtcgtacggaccaaccgtccgggtaccctacccgtagaacctacttcgtcgttacgggccctacggacgggtcttaggaggacgtacggnggtacttagttaagttttagttagtcgtcttgaccttacgtaagttaacggtacggtaaacctttcctttacgtttcctttaacgtacggttacgggtacgttacgggaaccctacggttacccgttccgttacggtaagtaccaaccgtacccgaaccgacccctaaccgttcgtcg

SEQ ID NO: 340715 - DNA, 634 bp, Homo sapiens
  misc_feature: GZ8MTXP01EOCMG.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccggtctccgtggcagtcagtcaccactcccctgcactggaaccagcaatgattgttggtacgttaataagtatgtctcagtcggtaccgcaacgaacccaggaccaaaccgcccccaagtccgtctctatgatgtacacgtaacgccgccctagacggactccctgactcgtattctctcggacctacaagtcgtaggaccaaacgccggccctacctagaactacttctcgtcgggtcctaccggaggtcctaggaggtagtcggaaggtcttaggttaatttagtttagttcgacgtgtacctagtaattaagtacggtaaacttaccctttacgtttccttttaaccgttcgttaccgggtaacttcgggaacccgttacggttacccgttaccggttccgtaacgggtcctaacgacccccgtaaacggacccctaaccccttgtcccg

SEQ ID NO: 340716 - DNA, 547 bp, Homo sapiens
  misc_feature: GZ8MTXP01BR5BX.11.59.F04.1.454.CMB.2.raw
  modified_base (141)..(141): a, c, t, g, unknown or other
  misc_feature (141)..(141): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (392)..(392): a, c, t, g, unknown or other
  misc_feature (392)..(392): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcgccatcccctgcactggaaccagcaatgatgttggtcgttataagtatgtctcatggtaccgnagaacccaggcaaacgcccccaagtcgttctctatgatgtacactaaagcggccctnaggatccctgatcgattcnctagcttccaaagtctaggcaaacgtacggccccctccctagaaaccatcctacgtgggctccgaaggcaggagactgagtntagtattatatgtntntctanatatagtaatacttacttcgtttcttcgttacgtacgtacggaccgtacgtacgtaccgtcctacgtacacgaccgaacgaccaacccacttcgtctacttcttcttccctccctccctctctcttctcgcgtg

SEQ ID NO: 340717 - DNA, 604 bp, Homo sapiens
  misc_feature: GZ8MTXP01AF9IA.11.59.F04.1.454.CMB.2.raw
  modified_base (216)..(216): a, c, t, g, unknown or other
  misc_feature (216)..(216): n is a, c, g, or t
  modified_base (263)..(263): a, c, t, g, unknown or other
  misc_feature (263)..(263): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccggtctccgtgggcagtcagtccactcctccgtnactacgtacgaacagactagtgtagtggttaggtacttaaagtagtntcgtctagtaggtacggtaccgacaaccgaaccgacgaacccaaaccccgaccccttagttcctctactagtgtatcgacaacgtcgcccgcctagacggtctcgtgtactacttctactcgcgtaccacgtgtcgacgacgaccgaccgtcctcgcactgacggnggtcgctacgattgataagcgtacgtaggcgttctaagttacttcgtacggnacgagtgngtaggcgtactaccgtacgtcggtaagttcgttcggttcgttaggggttccgggttacgggcgggaaggaccgtaacgcgtccggtaccgtacggttacgaaccgaaccgtaacg

SEQ ID NO: 340718 - DNA, 675 bp, Homo sapiens
  misc_feature: GZ8MTXP01AGZLO.11.59.F04.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccactccctgcactggaaccngcaatgattgttgtcttatagtntgtctcagtggtaccgcacgaaccgaggaccaacgccccctaagtcgttctctatgatcgtacacgtaacgccgcctgacggtctcccgtgacctcgtacttcgtcgtcgtaccttaccgtaagtcgtacgggaccaaaccgtccggtaccctacccgtagaacctacgttccgtaccgggtcggggtacccttaccggaaggggtccttaggggaaccgggtagttacgggaaacgggttccttaagggttaacttttagtttacgtttcgaccgttggtaccttactaaagttacgtacgggtaaacttaccttacgtttctttcgtacgttacgggtaaacgttcgggtaaccctacgggttccaccggttcgtaacgggtccaaccggtacccaccggttcccctaaacccgttgtaacccg

SEQ ID NO: 340719 - DNA, 716 bp, Homo sapiens
  misc_feature: GZ8MTXP01D8YW5.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtccaccactcccctgcactggaaccagcaatgattgttggtcgttatagtatgtctcagtcggtaccgcaacgaacccaggaccaaaccgcccccctaagtccgttctctatcgatcgtacacgtaacggcccggtccctacgacggtacgtccctgtacttccgattccgtcgtcggaaccttaccaacggtccgtacgggaccaaccgtacccggccctacccgtagaaacctcttccgtcgtcggggtcctaccgtagggctaggacggtatcgggaggtcttagttaattttagttacgttcgtccttaggccttacgtaagtttaacgtacgggtaaactttaccctttacctttccgtttttaaccgttccgtttaaccggggaaaccgtttccgggggaaacccttacccgggttcccgttacccggtttacccggttaaaccggggttccaacccgggttaccccgaaacccgggttccccctaaaacccccgttcgttaacccg

SEQ ID NO: 340720 - DNA, 694 bp, Homo sapiens
  misc_feature: GZ8MTXP01A42SX.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtggcagtcagtcaccactccctgcactcggaaccagcaatgattgttggtacgttataagtatgtctcagtcggtaccgcacgaacccaggaccaaaccgccccctaagtccgttctactatgatcgtacacgtacgccgcctcgacggcgtccctgtactcgtacttcgtcgtcggtacctaccgaacgttccgtacgggacccaaccgtaccgggtcccctacccgtacgaaacctcgttccgttaccggtcgggtacccttaccggacgggtccttagggaacgggtagttagggacggtacttaggtaacttttagttacgttcggcttaggtacccttaagtaagttaacggttacggtaaaccgtttacccttaacttttccgtttaacgtaccgtttacgggtaacgttaccgggaccctacgggttaccttccggttaccgttaacggacccaacggtaccccgaacgttaccccctaaacccgttcgtaaccg

SEQ ID NO: 340721 - DNA, 587 bp, Homo sapiens
  misc_feature: GZ8MTXP01DHV89.11.59.F04.1.454.CMB.2.raw
  modified_base (326)..(326): a, c, t, g, unknown or other
  misc_feature (326)..(326): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtcaccactcccctgccactggaaccagcaatgatgttggtcttaataagtatgtctcatggtaccgcagaacccaggccaaacgcccccaagtcgttctctatgatgtcactaagcggcctnacggagtccctgactcgtattctacgtggacctaccaagttcctggaccaaccgaccggcctaccgagaactatctcgtgggcctcgagctgacggntgagtctgtatttagttnttgctagtctacagttaacgtggtaaacttaccttacgtttcttttctacgtttacggaaccgttacgggtaccctacgggttaccgttacccgttacgtaagggtccaacgtacccgaacggacccctaacccgttcgttaaccg

SEQ ID NO: 340722 - DNA, 665 bp, Homo sapiens
  misc_feature: GZ8MTXP01BYXW6.11.59.F04.1.454.CMB.2.raw
  modified_base (258)..(258): a, c, t, g, unknown or other
  misc_feature (258)..(258): n is a, c, g, or t
  modified_base (433)..(433): a, c, t, g, unknown or other
  misc_feature (433)..(433): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtgtccgggtctccgtgggcagtcagtccaccactcccctgcactcggaaccagcaatgattgttggtacttataagtatntctcagtcggtaccggcaacgaacccaggaccaaaccgccccctaagtccgttactctatgatcgtacacgtaacggcgccctacgaggtacgtcctagacctacgtattcctcgtcgacctaccaagtcgtacgggaccaacccgaccggtccctcctagacctactcgttcgngggtcctacgacgggtctaggagggactggagtcgttagttaggttttaattaggttcgtacttgtcttacgttagtaacgttcgggtaaacctttacccgttactttcccttttctccggttaaacgggtacccgttacgggaaaccccgttcggttacccgttacccggttacggtaaccgtaccgaacccgaacccgtaaccggacccctaaccccgttcgttaacccg

SEQ ID NO: 340723 - DNA, 638 bp, Homo sapiens
  misc_feature: GZ8MTXP01EHSQV.11.59.F04.1.454.CMB.2.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccatcccctgcactggaaccagcaatgatgttggtcttaataagtatgtctnagtggaccgnacgaaccagccaacgccccaagtcgtctctatgatgtacacgtacgcgcctgagctcctgactcgtattctcgtcggtaccctcgaacgttccgtacgggacccaaaccgtacccggtcccttacccgtacgaaaccgtcttccgtcggtacgggtccctacgacgggtctaggaggtataggnggttacttagttacttttaagtttnttcggtctcggtctacgtagttaacgtaggttaaccttaaccctttctttctttcgtacgttaccgggaaacgttcggggaaccctaccgggttacccttccggttaccgtaaggtccaacggtaaccccgacggttacccctaacccgttaactttcccg

SEQ ID NO: 340724 - DNA, 678 bp, Homo sapiens
  misc_feature: GZ8MTXP01AJPSF.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtggcagtcagtcaccactcccctgcactggaaccagcaatgatgttggtcttataagtatgtctcagtcggtaccgcacgaaccaggaccaaaccgccccctaagtccgttctctatgatcgtcacgtaagccggtcctagacggacgtcccgtgtactcgtattctacgtggacccttaccgaagtcctgggaccaaccgaccggtccctaccgtagaacctacgtccgtcgtcgggccttccgacgggtctaggacggtacttggacgggtacttaggttaatttaagtttcgttacgtaccttcggtccttacgtaaggttacgttaacggggttaaaccttaaccctttacctttccgtttttccgtaccggtttaccgggtaaacgttccggggtaaaccctaccggttaccgttacccgttacccggtaacgggtccaaccggtaccccgaacggaccccctaacccgttaacggttcccg

SEQ ID NO: 340725 - DNA, 674 bp, Homo sapiens
  misc_feature: GZ8MTXP01D3242.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtcaccactcccctgccactcggaaccagcaatgatggttggtacttaatagtatgtctcagtcggtaccggcaacgaacccaggaccaaaccgccccctaagtcgttctctatgtatgtactaacgtacggccgcctagacggtacgtcctgactcgtacttctcgtcggtaacccttaccgtaagtccgtacgggaaccctaaccgcccggtacccttcccgtaataaccctgttccgtcggtcgggcccttacccgagggtctaggtacggatcgggaacggtcttagttaatttaacgttgtttcgaccgttgccttacgtaattaacggttacggtaacctttaaccctttcgttcttttcgtaccgttaacgggtaccgttaccggggaccttaccgggttacttccggttccgtaacggtacccgaacgtaccccgaaacgttcccctaaacccgttgttcccg

SEQ ID NO: 340726 - DNA, 670 bp, Homo sapiens
  misc_feature: GZ8MTXP01C310K.11.59.F04.1.454.CMB.2.raw
  modified_base (141)..(141): a, c, t, g, unknown or other
  misc_feature (141)..(141): n is a, c, g, or t
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcttataagtntgtctcagtggtaccggcagaacccagggccaaaccgcccccaagtcgttctctangatgtacaactaacgccgccctnaggactccctgatcgattcnctggtctaccgaagtctggaccaacgaccgccccctccctagaacctatcctcgttgggcctccgagggcctaggaggtactcggaacgtcttagtaatttactttagttcgtcgtgtaccttacgtaagttaacgttacgggtaaacttaccctttacttttccgttttcttacgtttccgggaaacgtcggggtaacccctacgggtacctaacccggtcgttaacgggtcccaaacggtacccccgaaacggtccccttaaacccccgtgttccgttacccaacctttccgttcccggtttaccccccaaccttcccgttaacgttactccgttccgtcgttccgtaaggg

SEQ ID NO: 340727 - DNA, 654 bp, Homo sapiens
  misc_feature: GZ8MTXP01BSUVW.11.59.F04.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactcggaacagcaatgattgttggtacttataagtntgtctanagtcggtacggacacggaacccaggacaaccgaccccctaagtcgttctactatgactgtacacgtaacgccgcctacgacggtactccctagtaccgtccgtattccgtcgtcggaacctcaaggttctacgggaccaaccgtccgtccctctacgaacctattccgtcgtcgggtacctcggtaacggcgtacgggaggacggtacggtacttaggttaactttaagggttgttcggcttacgccttacgaattaacggtacggttaaaccttaccgttacctttccttttacggtccgttacggttaacgtaccgggttaccgtaaccgggttcccaccggttcaacggtccaccggtaacccaaccggtaccaacccgtcgttcgtccc

SEQ ID NO: 340728 - DNA, 714 bp, Homo sapiens
  misc_feature: GZ8MTXP01E43HQ.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtctggggccccagggcagagggtcgccatctctgcactggtccacctcaatagtcggggcgttatggtatgctctggtatcaaacaacgtccaaggaatcggacccccaaatcctcatctatgctgaacaacaatcgaccttcgacgggggtccctagaccggttctcccgtggctaccgaagtctcgggaccttccgttcccgcccttcccgtttcgggaccctataccgacgttcggggaccttcggaagggtctacgggtaaccgaaggttcggaagggtccttaggtaactttaaccgtaacgttggttacctttcgggttaccctttttaggaaaccttaaatttaaaaccggtggtaagttggttagggttaacgttccggggacggggtaaacggggaacccctaacggttaaaccccggtccgttaacgggtcccgtaacgggacccccgaaacgggttccctccccggggtacccccccctgggttccccgtaccttcccgttaacccggttccccccttaaccccc

SEQ ID NO: 340729 - DNA, 765 bp, Homo sapiens
  misc_feature: GZ8MTXP01BYSE6.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcgaggtcgtccgggtctccgtgggcagtcagtcaccactccctgaccacgtcggaaccagactaatgtaagttggttacgggttacgtttaaataaggttattcgtctacgtagtcggtaacccggacaaaccgaaacccaacgaaccaaaaccgtccccccgtaagttccgttcctacgttatacgtaacttacggtacctaacggtaaaccggcccggtaccccttagaacgggttaccgtaccccgtagaaacccgtttccgtaacgttttccgtaccgtcggtaacccttaaccgtaacggtccgtacgggacccaaacccggacccggtaccccttacctagtaaaccctacttaccggtcggtaccggggtcccttaccggaacggtcgtagggaaggacgttacgggagtacttaggtaacttttagtttaacgtcgacgttcgaccttgtaattacgtaggtaaccttacctttacttctttccgttacgttaccgggtaacgcgggtaaccctcggttacccgttccggttaccgtaacggtaccaaccgtacccgacgaccccgtaacccttaacggtcc

SEQ ID NO: 340730 - DNA, 554 bp, Homo sapiens
  misc_feature: GZ8MTXP01DLO7C.11.59.F04.1.454.CMB.2.raw
  modified_base (142)..(142): a, c, t, g, unknown or other
  misc_feature (142)..(142): n is a, c, g, or t
  modified_base (295)..(295): a, c, t, g, unknown or other
  misc_feature (295)..(295): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagcgagagataccacgaccggtgctcgatttagtacacacacttagggattgggggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaaatgatgttggtcgttataagtatgtctcatggtaccggcaagaacccaggccaaaacgccccccaagtcgttctctatgatgtcactaagcggcctnaggagtccctgatcgattctctggctccaagtctggcaaacacggccccctccctagaacatctactgggctccaggctgaggatgagctgattatatgctgctanatangaatacttactttctttctcgttacggaacgtcggaccacggtctaccgtcgtagtcacgacccgaaacgccccaaccctattcgtacctacttccgttccttccccctaacccttccgtaaccgttactccttcctccgttggaacgg

SEQ ID NO: 340731 - DNA, 783 bp, Homo sapiens
  misc_feature: GZ8MTXP01AZ2M9.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctccgtggcagtcagtcaccatccctgcactggaaccagcaatgattgttggtcgttaataagtatgtctcagtggtaccgcaacgaacccaggaccaaacgccccccaagtcgttctactactgatcgtacaacgttacggcggccctcgaggctccctgactcgattctcgtcggcctacaagttctcgggacctaaaccgaccgggtcccctacccctacggaaacctacgttacccgtacgttcgggggtcccttacccggtaacgggcccgtttaggggaaccgggtaaacgttgggaacggggtccctttagggttaaccgttttaaagttttaacggtttcggtcccttacgggtacccttacttaaacggttaagtttacgggggtaaaacccgttttaaccccgtttaaaccgtttttcccttttttccccgttacgttttaccgggggtaaacccggtttaccggggggtaaaccccgttaaccggggttacccgttaccccggggtttaccccgtaacgggggttacccaaccgggtaacccccgaaacggggttaccccccctaaaccccttaaccggtttcccg

SEQ ID NO: 340732 - DNA, 695 bp, Homo sapiens
  misc_feature: GZ8MTXP01AFXOQ.11.59.F04.1.454.CMB.2.raw
  modified_base (263)..(263): a, c, t, g, unknown or other
  misc_feature (263)..(263): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccggtctccgtggcagtcagtcaccactccctgcactaggaaccagctaatgattgttaggtacgttaataagtatcgtctnagtcggtacgcaacgaaccaggaccaaccgcccccaagtcgtctactatgatcgtacacgtaagccgtaccgtacgaggactcccgtagtacctcgtacttctacgtcgaaccttaccgtaagttccgtacggacaaaccgaccggtaccctaccgttaacgaacctacgttccgtccggttcgggacccttacggtaacgggcgttaggaacggtagtagggacggtacttaaggttaaactttagttaacgttcgtcctaggtaccctactaaacgttaagtacgggtaaaccttaccttttacgtttccttttaacgtcgtttacgggaaaccgttacggggaacccttaacgggttacccgttaccggttaccgttaacggtccaaccggtaaccccgaacggacccctaaacccgttcgtttaaccg

SEQ ID NO: 340733 - DNA, 653 bp, Homo sapiens
  misc_feature: GZ8MTXP01EULFX.11.59.F04.1.454.CMB.2.raw
  modified_base (280)..(280): a, c, t, g, unknown or other
  misc_feature (280)..(280): n is a, c, g, or t
  modified_base (432)..(432): a, c, t, g, unknown or other
  misc_feature (432)..(432): n is a, c, g, or t
  modified_base (485)..(485): a, c, t, g, unknown or other
  misc_feature (485)..(485): n is a, c, g, or t
  modified_base (501)..(501): a, c, t, g, unknown or other
  misc_feature (501)..(501): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtcccgggtctccgtgggcagtcagtccaccactccctgcacgtggaaccagcaatgtattggttaggtcgttaatagtatgtctacgagtcggtaccgtnacggtaaccgaggaccaaaccgtcccccgtaagttcgttactctagtacgtactcgtacacgtaacgccggtccctacgacggtcgtacccttgacctcgtattctcgcgtacacctaacgtcgtggaccacgccggtcctcctagaacctnttcgcgtcgggcctacgacggtcgacgaggctcggacgtattgttaaactttntttaggtctacgttcnctcgtataaggtacgttaaccgttcttactttccttcttacggttcggtaaaccgttaccgggcccgtaaacgggtttccccttaacgggttccgtaaggggtccctaaaccgggacctaaacccgggccccctaaaccgttccgttaaccg

SEQ ID NO: 340734 - DNA, 693 bp, Homo sapiens
  misc_feature: GZ8MTXP01EL3LI.11.59.F04.1.454.CMB.2.raw
  modified_base (495)..(495): a, c, t, g, unknown or other
  misc_feature (495)..(495): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtcccgggtctccgtgggcagtcagtccaccactccccctgaccacgtcggaacccagactaatgtattggttaggtacgtttaataagtatgtctgagtcggtaccgacaacgaacccgaggaccaaaccgcccccgtaagtccgttcgtactagtcgattcgtactaacgtaacggccggtaccctagacggtactccctagtaacctcgtacttccgtcgtcggtaacctccgtaagtccgtcggaaccaaccgtacccggtcccttacccgtagtaacctcttaccgtcggtacgggccttaccgacggtnttaggaaggtagtacggagtacttaggtatttaagttacgttcgtctacgtccttagtaacgttaagttaccggtaactttacccgttctttcctttaaccgttcgttaccgggaaccgttacgggacccgttaccggttccgttaccgttacgtaacgtaccgaaccgtacccgaaccgacccctaaccgcggttcc

SEQ ID NO: 340735 - DNA, 619 bp, Homo sapiens
  misc_feature: GZ8MTXP01AIQ9T.11.59.F04.1.454.CMB.2.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (586)..(586): a, c, t, g, unknown or other
  misc_feature (586)..(586): n is a, c, g, or t
tcagcgagagataccacgaccggtgctcgatttagtacacacacttagggggctgggggtctcaggaggcagcactctcggggacgtctccaccatggcctgggctctgctcctcctcagcctcctcactcagggcacaggatcctgggctcagtctgccctgactcacgcccgctcagtcggtcccgggtctccgtgggcagtcacgtcaccactccctgcacgtacgaacagacaatgtattggttaggtacttaagtaagtatcgtcgtangtacggtaccgntacgaaccagaccaacgccccagtcgtntcagtagatcgtacacgtacgccgtcctagacggtacgtcctagacctacggttactctcgtcggtaaccttacgaacgtcgtacggacaaccgtcgtcctacggtacaaccgtctcggtactccggggtcctcgtaacggtcgtaggtaagggactcggtatcgttagttaggtttaagtttcggttaggtcttcggactcgtaacgttaagccgttaaactacctacgttccttcgtcgttcgtaacgcgaccgtacggttcttaccggntcggtcaacgtccgacgttcccaacgttcgtcc

SEQ ID NO: 340736 - DNA, 501 bp, Homo sapiens
  misc_feature: GZ8MTXP02FWRNI.11.59.F04.1.454.CMB.2.raw
  modified_base (418)..(418): a, c, t, g, unknown or other
  misc_feature (418)..(418): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggcctcagagtccctgactcgattctctgctccagtctggcaacacggctccctgaacatctctgggctccaggctgaggatgagctgattatattgctgctanatatgatactacttctttctcgttacgacgtcggacctacgtccaccgtccgtaagtcacgacccaacgacccaacccactcg

SEQ ID NO: 340737 - DNA, 516 bp, Homo sapiens
  misc_feature: GZ8MTXP02J2R21.11.59.F04.1.454.CMB.2.raw
  modified_base (233)..(233): a, c, t, g, unknown or other
  misc_feature (233)..(233): n is a, c, g, or t
  modified_base (437)..(437): a, c, t, g, unknown or other
  misc_feature (437)..(437): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (495)..(495): a, c, t, g, unknown or other
  misc_feature (495)..(495): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgnagaacccaggcaaacgcccccaagtcgtctctatgatgtcactaagcggccctcaggacgtccctgatcgattctctggctccaagtctggacaacacggcccctccctgaacatctctgggcctccaggctgagatgaggctagatttattattgctgctcatatggaattacctattcttttctcttcggaacttgggaccncggtcaccgtctaggtcacgcccaacggcccaaaccccnctcncnctcctcgtccccncctcctcgtctcctctcgctg

SEQ ID NO: 340738 - DNA, 513 bp, Homo sapiens
  misc_feature: GZ8MTXP02HQ7Z8.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgttctctatgatgtcactaagcggccctcaggagtccctgactcgattctctggcctcagtctggcaacacggcctcctgaacatctctcgggctccgaggctgaggatgaggctgatttatttatgctgctcatagtggaattacctacttcttttctcgtttacggaacttgggaccacggtccaccgttcaaggtcacgcccaagcccaacccgactcg

SEQ ID NO: 340739 - DNA, 575 bp, Homo sapiens
  misc_feature: GZ8MTXP02GL8QK.11.59.F04.1.454.CMB.2.raw
  modified_base (461)..(461): a, c, t, g, unknown or other
  misc_feature (461)..(461): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttatagtatgtctcatggtaccggcacgaacccaggacaaaccgccccccaagtcgttctctatgatgtcactacgccggccctacgaggacgtccctgactcgtattctcgtcggcctcagtcctagggaccaaccgaccgggtccctcccgtagaaacctatcctcgtggggccttcccgaggcctggaggactggaggctgatttattatgctgcctanatagtaggaacttacctacttcttttactcgtttacggaacgttcgggaacctaccgggtacctacccggttcgtaacggtcacgaccccaaacgaccccaacccctagttccg

SEQ ID NO: 340740 - DNA, 529 bp, Homo sapiens
  misc_feature: GZ8MTXP02HKYX7.11.59.F04.1.454.CMB.2.raw
  modified_base (223)..(223): a, c, t, g, unknown or other
  misc_feature (223)..(223): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccngcaatgatgttggtcgttataagtatgtctcatggtaccgcagaacccaggacaaacgcccccaagtcgttctctatgatgtcactaagccggcctcgaggacgtccctgactcgattctctggctcagtctggaccaacaccggccctcctgaaacatctctcgggctccgaggctgaggntgacggntgtatttattatgtctgcttacatatggaattacctacttcttttctcgttacggaactcgggaacctacggtctaaccgtctaacggtcaacgcccaacgccccaacccacgtccg

SEQ ID NO: 340741 - DNA, 539 bp, Homo sapiens
  misc_feature: GZ8MTXP02GWTT2.11.59.F04.1.454.CMB.2.raw
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcaagaacccaggcaaacgccccccaagtcgtctctatgatgtcactaagcggccctcaggacgtccctgactcgattctctggctcagtctggcaacncgcctcctagaacntctctggctcgagctgaggatgagtctgtattattattgctgctacattagtaggtaacgttacctacttccttttctccgttacggtaactcgggaaccctacggtccaacccgtccgtaacggtcacggacccctaacggaccccaaaccccgtactccg

SEQ ID NO: 340742 - DNA, 500 bp, Homo sapiens
  misc_feature: GZ8MTXP02F2X5R.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgttctctatgatgtcactaagcggcctcaggatccctgactcgattctctgctcagtctggcacacgcctcctgaacatctctggctcgagctgagatgagctgattattattggtgctcatatggaatcctactctttctcttcggaactcgggaccacggtccaccgtcctaggtcacgcccaacggcccaacccgactcgtacc

SEQ ID NO: 340743 - DNA, 538 bp, Homo sapiens
  misc_feature: GZ8MTXP02IQG49.11.59.F04.1.454.CMB.2.raw
  modified_base (423)..(423): a, c, t, g, unknown or other
  misc_feature (423)..(423): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaacgccccccaagtcgtctctatgatgtcactaagcggccctcagacgtccctgactcgattctctggcctcagtctggcacacggcctcctgaacatctctgggctccgagctgaggatgagctagattagttattgctgcctanattatagggaacttacctacttcttttactcgttacggtaaacgtcggggaacctacggtaccaaccgttcctaagggtccaacggtccccaaacggacccaaccccgacttccg

SEQ ID NO: 340744 - DNA, 489 bp, Homo sapiens
  misc_feature: GZ8MTXP02IF6KS.11.59.F04.1.454.CMB.2.raw
  modified_base (140)..(140): a, c, t, g, unknown or other
  misc_feature (140)..(140): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (255)..(256): a, c, t, g, unknown or other
  misc_feature (255)..(256): n is a, c, g, or t
  modified_base (258)..(259): a, c, t, g, unknown or other
  misc_feature (258)..(259): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (277)..(279): a, c, t, g, unknown or other
  misc_feature (277)..(279): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (352)..(353): a, c, t, g, unknown or other
  misc_feature (352)..(353): n is a, c, g, or t
  modified_base (355)..(356): a, c, t, g, unknown or other
  misc_feature (355)..(356): n is a, c, g, or t
  modified_base (358)..(358): a, c, t, g, unknown or other
  misc_feature (358)..(358): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcttataagtatgtctcatggtaccgnagaaccngacaacgcccagtctnnanntncacagcgcncagcncnnnctntctctgctcatncgacacacgccctcctacacatctcgtcgctcngcgtgagagngngntntattatatnntnntntatatagtacgtacttacttctttcttacgttacgtacgtacgtaccgacgtacgtaccgtacgtacgtacgacgaccaacgaccacccactactactactctcgtcctccgtcctctctctctcgcgtcg

SEQ ID NO: 340745 - DNA, 498 bp, Homo sapiens
  misc_feature: GZ8MTXP02GU01X.11.59.F04.1.454.CMB.2.raw
  modified_base (224)..(224): a, c, t, g, unknown or other
  misc_feature (224)..(224): n is a, c, g, or t
  modified_base (439)..(439): a, c, t, g, unknown or other
  misc_feature (439)..(439): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccggcagaacccaggcaaagcccccaagtcgtctctatgatgtcactaagcggcctcaggagtccctgactcgattctctggctccagtctggcaacacggcctcctgaacatctctgggctccagctgaggatgaggctgattattatgctgctcatatggaatacctactcttttcncttcggaacttgggacctacggtcaccgtcctaagtcacgcccaaggcccaacccatcg

SEQ ID NO: 340746 - DNA, 496 bp, Homo sapiens
  misc_feature: GZ8MTXP02G4OTL.11.59.F04.1.454.CMB.2.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (406)..(406): a, c, t, g, unknown or other
  misc_feature (406)..(406): n is a, c, g, or t
  modified_base (459)..(459): a, c, t, g, unknown or other
  misc_feature (459)..(459): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcgttataagtatgtctcatggtaccgnagaacccaggcaaacgcccccaagtcgttctctatgatgtcactaagcgcctcaggagtccctgactcgattctctggctcagtctggcaacacgcctcctgaacatctctgggctcccgagcctgagatgaggctgattntatgcttgctcatatggaattacctattcgtttactcttcggaacgtggaccncggtcaccgtcaaggtcacgccaagccaaccccatcg

SEQ ID NO: 340747 - DNA, 510 bp, Homo sapiens
  misc_feature: GZ8MTXP02IUNU8.11.59.F04.1.454.CMB.2.raw
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgtctctatgatgtcactaagcggcctcaggagtccctgactcgattctctggctcagtctgcacncgctcctgacntctctggctcaggctgagatgagctgtattattattgctgctcattagtaggaagttacctacttcttttctcgtttcggaacttggggacctacggtcctaaccgtcctaaggtccagtcccaaggcccaacccgacttcg

SEQ ID NO: 340748 - DNA, 494 bp, Homo sapiens
  misc_feature: GZ8MTXP02IS9X4.11.59.F04.1.454.CMB.2.raw
  modified_base (297)..(297): a, c, t, g, unknown or other
  misc_feature (297)..(297): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggagaacccaggccaaagccccccaagtcgttcnctatgatgtcactaagcggcctcaggatccctgatccgattctctggctccaagtctggcaacacgcctcctgaacatctctggctccaggctgagatgagctgattatattgcttgctcatatggaaatcctatctttctcttcgaactcgggaccacggtcaccgtctaggtcacgccaggccaacccatctacc

SEQ ID NO: 340749 - DNA, 520 bp, Homo sapiens
  misc_feature: GZ8MTXP02HYBUG.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcttataagtatgtctcatggtaccggcagaacccaggcaaagcccccaagtcgttctctatgatgtcactaagcggccctcacggagtccctgactcgattctctggctcagtctggcaacacgcctcctgacatctcgtcgggctcccgaggctaggacggatgaggtctggtatttattatgtctgtctcatatggtaacgttacctacttctttctacgttcggaaactcgggaccacggtcctaccgtcgtaagtcacgcccaagcccaacccactccg

SEQ ID NO: 340750 - DNA, 554 bp, Homo sapiens
  misc_feature: GZ8MTXP02JBRUC.11.59.F04.1.454.CMB.2.raw
  modified_base (379)..(379): a, c, t, g, unknown or other
  misc_feature (379)..(379): n is a, c, g, or t
  modified_base (549)..(549): a, c, t, g, unknown or other
  misc_feature (549)..(549): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgccactggaaccagcaatgatgttggtcttataagtatgtctcatggtaccgcagaacccaggcaaacgcccccaagtcgttctctatgatgtcactaagccggccctcgaggacgtccctgactcgattctctggctcagtctggccacgccgcctccctgaaacntctcgtgggcctccgaggctaggagctgaggctgtatttattagttgctagctacattagtaggtaacttacctactttcttttctacgtttacggaaacgttcgggaccctacgggttaccacccggttccaacggtccacggtaccccgaaggcccctaaaccccgtntaccg

SEQ ID NO: 340751 - DNA, 543 bp, Homo sapiens
  misc_feature: GZ8MTXP02IUDIY.11.59.F04.1.454.CMB.2.raw
  modified_base (223)..(223): a, c, t, g, unknown or other
  misc_feature (223)..(223): n is a, c, g, or t
  modified_base (426)..(426): a, c, t, g, unknown or other
  misc_feature (426)..(426): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccggcagaacccaggcaaacgcccccaagtcgtctctatgatgtcactaagcggccctcaggatccctgactcgattctctggctcagtctggccaacaccggcctccctagaaccatctctgggcctccagctgaggatgaggctagatttattagttgctgcctnatatggaaacgttacctacttccttttctacctttacgggaaaccttcggggacctacgggtaccaccgttctaagggtccacggaccccaaacggccccaaaaccccgtgttcccg

SEQ ID NO: 340752 - DNA, 532 bp, Homo sapiens
  misc_feature: GZ8MTXP02F9P0R.11.59.F04.1.454.CMB.2.raw
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcgttataaagtatgtctcatggtaccggcagaaccccaggcaaagccccccaagtcgttctctatgatgtcactaagcggccctcaggagtcccctgactcgattctctggcctccagtctggcaacgacgcctccctgaaacatctctgggctccaggctgaggatgaggctgattattattgtctntctnatatagtaagtactacttctttcttcttacgtacgtacggaccgtaccgtaccgtaccgtaccgtaacgtacgacgaccgaaccgacccaacccctacctacg

SEQ ID NO: 340753 - DNA, 508 bp, Homo sapiens
  misc_feature: GZ8MTXP02GRC0L.11.59.F04.1.454.CMB.2.raw
  modified_base (374)..(374): a, c, t, g, unknown or other
  misc_feature (374)..(374): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgactcgattctctggctcagtctggcacacgcctcctgaaacntctcgtggctccgagctgagatgaggctgatttattatgctgctcatagtaggaatacctacttctttctcttacggaacttcgggacctacggtcaccgttctaaggtcacgcccaacgcccaaacccgctcg

SEQ ID NO: 340754 - DNA, 527 bp, Homo sapiens
  misc_feature: GZ8MTXP02FYE39.11.59.F04.1.454.CMB.2.raw
  modified_base (289)..(289): a, c, t, g, unknown or other
  misc_feature (289)..(289): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
tcagcgagagataccacgaccggtgctcgatttagtacacacacttagggattgggggctttgtctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagcggccctnaggagtccctgatcgattctctggctcaagtctggcaacgacggcccctccctgaacatctctgggctccaggctgaggatgagctgtattatattgctgctnatntagaatacctatcttttacnctttacgaactgggaacccaggtcaccgtcctaggtcacggacccaacggcccaaacccctctcgtacctaccttctcctaccccaaccctcctacgtactcctctcgctgg

SEQ ID NO: 340755 - DNA, 503 bp, Homo sapiens
  misc_feature: GZ8MTXP02FZO7G.11.59.F04.1.454.CMB.2.raw
  modified_base (420)..(420): a, c, t, g, unknown or other
  misc_feature (420)..(420): n is a, c, g, or t
tcagcgagagataccacgaccggtgctcgatttagtacacacacttagggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgtctctatgatgtcactaagcggccctcaggagtcccctgactcgattctctggctccagtctggcaaccacgcctccctgaacatctctgggctccaggctgaggatgagctgattatattgctgctnatatggatacctattcttttctctttcggaactgggacctacggtcaccgtcctaaggtcagacccaaggcccaacccactcg

SEQ ID NO: 340756 - DNA, 305 bp, Homo sapiens
  misc_feature: GZ8MTXP02HKJZF.11.59.F04.1.454.CMB.2.raw
  modified_base (303)..(305): a, c, t, g, unknown or other
  misc_feature (303)..(305): n is a, c, g, or t
tcagcgagagataccacgaccggtgctcgatttagtacacacacttagggattgggcagcctgacatctgaggacacggccatatattactgtgcaatcagttataggacgtcgtccgagggctactttgactcttggggccagggaaccctggtcaccgtctcctcagcctccaccaagggcccatcggtcttccccctggcgccctgctccaggagcacctccgagagcacagcggccctgggctgcctggtcaaggctacttccgtatctctcgctgagcgggctggcaaggcgcatagnnn

SEQ ID NO: 340757 - DNA, 579 bp, Homo sapiens
  misc_feature: GZ8MTXP02JS8P8.11.59.F04.1.454.CMB.2.raw
  modified_base (387)..(387): a, c, t, g, unknown or other
  misc_feature (387)..(387): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcgttataagtatgtctcatggtaccgcacgaacccaggacaaacgccccccaagtccgttctctatgatgtcactaacgcggccctcgaggtacgtccctgacctcgattctcgtggctcagtctggaccaacgacgcctcctagaactntctctcgggcctcgaggtctggacggatggagtactgtaatttagttattgtcgtgtacctactaagttagtacgggtaacttacctacttcttttacgtcgtttacggaccgttcgggaccgtaccggttaccaccggttacccgtaaggtccgtaccggacccgaaacggcccctaaaccccgcgttccg

SEQ ID NO: 340758 - DNA, 555 bp, Homo sapiens
  misc_feature: GZ8MTXP02G3XPW.11.59.F04.1.454.CMB.2.raw
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcacgaacccaggcaaacgcccccaagtcgtctctatgatgtcactaagcgcctnagntccctgactcgattctcgtgctacagtctacggcaaccgaccggccctcctagaaactatcctcgtcgggcctcccgaggcctaggaggagtgaggctagtaattagttatgctgctcatataggaactactacttcttttctcgtttacggaaactcggggaaccctacggtaccctaccgttacctaacggtccaacggaccccaaacggaccccaaaacccctacttaccg

SEQ ID NO: 340759 - DNA, 658 bp, Homo sapiens
  misc_feature: GZ8MTXP02HGO2J.11.59.F04.1.454.CMB.2.raw
  modified_base (260)..(260): a, c, t, g, unknown or other
  misc_feature (260)..(260): n is a, c, g, or t
  modified_base (394)..(394): a, c, t, g, unknown or other
  misc_feature (394)..(394): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagacccaggcaacgccccaagtcttcnctatgatgtcactaagccggcctcaggactccctgatcgattctctggctccaagtctgcaacacgcccctcctgacatctctgggctccaggcctgaggatggaggtctagtatttatagttgctagtcctanattacgtggtaaacttacccttactttacctttttccgttacgtttaccgggaaacgttccgggggtaaccctacgggggttaccctaaccccggttcccgttaaggttcccgaaaccggtccccctaaaacggggtcccccaaaaccccctacggttccgtaccctaacccgtttcccgttccgttttaccccccccaaccccgtttacccgttaccgtttaaccttccccgttaccctttcccccggtaaggtcccccgggg

SEQ ID NO: 340760 - DNA, 542 bp, Homo sapiens
  misc_feature: GZ8MTXP02G9RZA.11.59.F04.1.454.CMB.2.raw
  modified_base (232)..(232): a, c, t, g, unknown or other
  misc_feature (232)..(232): n is a, c, g, or t
  modified_base (516)..(516): a, c, t, g, unknown or other
  misc_feature (516)..(516): n is a, c, g, or t
tcagcgagagataccacgaccggtgctcgatttagtacacacacttagggattgggggctttgcctgggctctgctcctcctcagcctcctcactcagggcacaggatcctaggctcagtctgccctgactcagccccgctcagtgtccgggtctcctgggcagtcagtcaccatcccctgcactggaaccagcaatgatgttggtcttataagtatgtctcatggtaccgnagaacccaggcaaacgcccccaagtcgtctctatgatgtcactaagccggccctcgaggacgtccctgatcgattctctggctccaagtctggcaacgacggcccctccctagaacactctcgtcgggcctccaggctgagactgaggctgtattatatgctgctcatatggaacttacctacttcttttctcgttcggtaacgtggacctacggtccaccgtcgtaggtccacgacccctaacggcccctaaacccgctcgtactaccgtcctccgttccccnccgttctaccgtctcctctcgtcgtg

SEQ ID NO: 340761 - DNA, 506 bp, Homo sapiens
  misc_feature: GZ8MTXP02F82GJ.11.59.F04.1.454.CMB.2.raw
  modified_base (224)..(224): a, c, t, g, unknown or other
  misc_feature (224)..(224): n is a, c, g, or t
  modified_base (357)..(357): a, c, t, g, unknown or other
  misc_feature (357)..(357): n is a, c, g, or t
  modified_base (414)..(414): a, c, t, g, unknown or other
  misc_feature (414)..(414): n is a, c, g, or t
  modified_base (501)..(501): a, c, t, g, unknown or other
  misc_feature (501)..(501): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccggcagaacccaggcaaacgccccccaagtcgttctctatgatgtcactaagcgcctcaggatccctgactcgattctctgctcagtctggcaacncgcctcctgaacatctctgggctccgagctgaggatgagctgattattatgctgctnatatggaactctacttctttctcttacggaacttcgggacctacggtcaccgttcgaaggtccacgaccctaaggacccaacccgtntaccg

SEQ ID NO: 340762 - DNA, 559 bp, Homo sapiens
  misc_feature: GZ8MTXP02FL82D.11.59.F04.1.454.CMB.2.raw
  modified_base (224)..(224): a, c, t, g, unknown or other
  misc_feature (224)..(224): n is a, c, g, or t
  modified_base (554)..(554): a, c, t, g, unknown or other
  misc_feature (554)..(554): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatccctgcactggaaccngcaatgatgttggtcgttataagtatgtctcatggtaccggcacgaacccaggacaaacgcccccaagtcgttctctatgatgtacacgtaacgccggcctcgacggacgtccctgactcgtacttctcgtggcctcagtctggacaacgaccgtcctacctagaaactacttcctcgtcggggcctaccgacggccttaggaggtatggacgtcttagtatttattagttgacgtgtcctatatagtaggtaacttaccttacttcttttctcgttacgaacgttcggactcggtacaccgtctaaggtcacgtaccacgacccaaccnctccg

SEQ ID NO: 340763 - DNA, 551 bp, Homo sapiens
  misc_feature: GZ8MTXP02JDOB3.11.59.F04.1.454.CMB.2.raw
  modified_base (357)..(357): a, c, t, g, unknown or other
  misc_feature (357)..(357): n is a, c, g, or t
  modified_base (437)..(437): a, c, t, g, unknown or other
  misc_feature (437)..(437): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggacaaacgccccccaagtcgtctctatgatgtcactaagccggcctcgaggactccctgactcgtattctctggctccagtcnggccaacaccggcctcctagaacatcctcgtgggctcccgagctaggaggatgaggctgtattatttagtcgtctgcctnaagttagtaggtaacttacctacttcttttcctcgttaccggaactgggaacctaccgtaccgtaccgtccgtaacggtccacgtaccccgaacgaccccaacccgtacttccg

SEQ ID NO: 340764 - DNA, 587 bp, Homo sapiens
  misc_feature: GZ8MTXP02GNBK9.11.59.F04.1.454.CMB.2.raw
  modified_base (324)..(324): a, c, t, g, unknown or other
  misc_feature (324)..(324): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcacgaacccaggacaaacgcccccaagtcgtctctatgatgtacactaagccggccctnaggacgtccctgactcgattctctggctcagtctggcaacaccgcctcctgaaccatcctcgtgggcctccgaggcctgaggtatgaggtctagtatttagttagttcgcttgcttcaagttatagggtaaacttacccttactttcctttttctacgtttacggaaaccgtttcggggaaccctaaccggggttccaaccccggttcctaagggtacccaacgggacccccaaaacgggccccaaaacccccgtacgttacg

SEQ ID NO: 340765 - DNA, 500 bp, Homo sapiens
  misc_feature: GZ8MTXP02I44AS.11.59.F04.1.454.CMB.2.raw
  modified_base (224)..(224): a, c, t, g, unknown or other
  misc_feature (224)..(224): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccgcagaacccaggcaaagccccccaagtcgtctctatgatgtcactaagcggccctcaggagtccctgatcgattctctggctcagtctggcacncggctcctgaacntctctgggctccaggctgagatgaggctgattattattgcttgctcatatggatacctactcttttctctttcggaacttcgggacctacggtcaccgttctaaggtcagcccaaggcccaacccgactcg

SEQ ID NO: 340766 - DNA, 501 bp, Homo sapiens
  misc_feature: GZ8MTXP02GQKED.11.59.F04.1.454.CMB.2.raw
  modified_base (224)..(224): a, c, t, g, unknown or other
  misc_feature (224)..(224): n is a, c, g, or t
  modified_base (497)..(497): a, c, t, g, unknown or other
  misc_feature (497)..(497): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcgttataagtatgtctcatggtaccggcagaacccaggcaaagcccccaagtcgttctctatgatgtcactaagcggccctcaggagtccctgactcgattctctggctcagtctggcacacggctccctgaacatctctgggctcccaggctgaggatgagctgattattatgctgctcatatggaagtcctacttcttttctcttggaaacttggggaccacggtcaccgtctaaggtcagcccaaggccaaacccnctcg

SEQ ID NO: 340767 - DNA, 501 bp, Homo sapiens
  misc_feature: GZ8MTXP02FSC8S.11.59.F04.1.454.CMB.2.raw
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgccccccaagtcgttctctatgatgtcactaagcggccctcaggagtccctgatcgattctctggctccaagtctggcaacacggcccctccctgaacatctctgggctccaggctgagatgagctgattatatgctgcctanatgagactactacttcttctcgtacgagtcgaccgcgtcaccgtcgcgtacacgaccgacgacccaacctcgtcacnctctcctcccaacctctactctctcnctcncgg

SEQ ID NO: 340768 - DNA, 535 bp, Homo sapiens
  misc_feature: GZ8MTXP02GTMX6.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgtctctatgatgtcactaagcgcctcaggagtccctgactcgattctctggctcagtctggcaacacggcctcctgaacatctctgggcctccgaggctgaggactgaggctagattattattgctgctcatagtaggtaattacctacttcttttctcgtttacggaacgtcgggaccctacggtaccaacccgttccgtaagggtccacggaccccaaggacccctaaaccccgtacgtccg

SEQ ID NO: 340769 - DNA, 502 bp, Homo sapiens
  misc_feature: GZ8MTXP02GXUO2.11.59.F04.1.454.CMB.2.raw
  modified_base (342)..(342): a, c, t, g, unknown or other
  misc_feature (342)..(342): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
  modified_base (498)..(498): a, c, t, g, unknown or other
  misc_feature (498)..(498): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaacgccccccaagtcgttctctatgatgtcactaagcggccctcaggagtccctgactcgattcnctggctcagtctggcaacaccggcctccctgaacatctctggggctccgagctgagatgaggctgattattatgctgctnatatggaatacctactcttttcncttggaactgggaccacggtccacgtcaaggtcacgtcccaaggccaacccgntacg

SEQ ID NO: 340770 - DNA, 548 bp, Homo sapiens
  misc_feature: GZ8MTXP02HXPV2.11.59.F04.1.454.CMB.2.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtacgcagaaccaggacaaacgcccccaagtccgttctctatgatgtcactaagccggccctcgaggacgtccctgactcgattctctgctcagtctgcacacgcncctgacntctctggctccagctgagatgagtctgtattattatgctgctactattagtaggtaacgttacctactttccttttcgtctttacgggaaaccttcggggaacctaccggggttacctacccggttaccgtaacggttaccacggaccccgaaacggcccccaaacccctactcccg

SEQ ID NO: 340771 - DNA, 590 bp, Homo sapiens
  misc_feature: GZ8MTXP02JEM7U.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatggttggtcgttataagtatgtctcatggtaccggcagaacccaggacaaacgcccccaagtcttctctatgatgtacactaacgccggccctcgacggtacgtcccgtgacctcgtattcctctggcctcagtctggccaaccgccggccctccctagaaaccatcctcgtcgggcctccgaggcctggacggatggagtcttagtattattatgtctgctactatagtacggtaattcctacttcttttacttccgttacggtaaaccgttcggggaaccctaccggtcctaacccggttccgtaacgggtccaaccgggaccccaaacggaccccctaaaccccgcgttacccgg

SEQ ID NO: 340772 - DNA, 545 bp, Homo sapiens
  misc_feature: GZ8MTXP02I396R.11.59.F04.1.454.CMB.2.raw
  modified_base (368)..(368): a, c, t, g, unknown or other
  misc_feature (368)..(368): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcgttataagtatgtctcatggtaccgcagaacccaggacaacgcccccaagtccgtctctatgatgtacactaacgccggcctcgacggtactccctgactcgtattctctcggcctcagtctggacaacnccgcctcctagaacactctcgtacgggcctccgaggctggagatggagctagtatttattagtgtcgtgctcattagtaggaacttaccttacttctttctacgttacggacgttcgggacctacgtacctaccgtaccgtaaggtccacgacccaacggacccaacccgtactccg

SEQ ID NO: 340773 - DNA, 561 bp, Homo sapiens
  misc_feature: GZ8MTXP02HMDR8.11.59.F04.1.454.CMB.2.raw
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (553)..(553): a, c, t, g, unknown or other
  misc_feature (553)..(553): n is a, c, g, or t
tcagcgagagataccacgaccggtgctcgatttagtacacacacttagggattgggggctttgtctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggccaaacgcccccaagtcgttctctatgatgtcactaagccggccctcaggactccctgactcgattctctgctcagtctgcaacncgcccctcctagacatctctgggcctcgaggctgaggatgaggctgattatatgntgctnatataggtaactaccttacttctttttctcgttaccggtaacgtcggggaacctaccgggtcctaacccgttccgttacggtaccacgaccccaaaacgggcccccaaacccctacgtcgtacctacctcctcgttccccaacccttcgtaccttactccttccncgtctcgg

SEQ ID NO: 340774 - DNA, 515 bp, Homo sapiens
  misc_feature: GZ8MTXP02JVXLR.11.59.F04.1.454.CMB.2.raw
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaagccccccaagtcgtctctatgatgtcactagccggccctcaggagtcccctgactcgattctctggctccagtctggcaacncggcctccctgaacatctctgggctcccaggcctggaggntgaggctgattattattgctgctcatatggaatacctatcttttctcttcggaactgggacctacggtccaccgtcctaaggtccacggcccaacggccctaacccccattccg

SEQ ID NO: 340775 - DNA, 504 bp, Homo sapiens
  misc_feature: GZ8MTXP02HFTON.11.59.F04.1.454.CMB.2.raw
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagcccgctcagtgtccgggtctcctgggcagtcagtcaccatccctgcactggaaccagcaatgatgttggtcgttataagtatgtctcatggtacggcagaccaggcaacgcccccaagtcgtctctatnatgtcactaagcgcctcagactccctnactcgattcnctgctcagtctgcacncgctcctnacntctctgggctccgagcctgacggatgaggctgtattcttatgcttgctacatatggaacttacttacttcgtttctcgttcggtaacgtcggacctacggtcctaccgtcgtaaggtcacgtacccaacggccctaacccactcg

SEQ ID NO: 340776 - DNA, 497 bp, Homo sapiens
  misc_feature: GZ8MTXP02GXE56.11.59.F04.1.454.CMB.2.raw
  modified_base (407)..(407): a, c, t, g, unknown or other
  misc_feature (407)..(407): n is a, c, g, or t
tcagcgagagataccacgaccggtgctcgatttagtacacacacttagggctgggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggcctcagagtccctgactcgattctctggctcagtctggcaacacggcctccctgaacatctctgggctccgaggctgaggatgaggctgattntatgctgctcatatggaatacctacttctttctcgttcggaactgggaccacggtcaccgtctaaggtcacgcccaaggccaacccagtc

SEQ ID NO: 340777 - DNA, 516 bp, Homo sapiens
  misc_feature: GZ8MTXP02JE9BS.11.59.F04.1.454.CMB.2.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtctatagtatgtctcatggtaccgcagaacccaggcaaacgcccccaagtcgtctctatgatgtcactaagcggccctnaggactccctgactcgattcnctggctcagtctggcacacgcctccngaacntctctggctcgagctgagatgagctgattattatgctgctcattagtggtaacttacctacttcttttactcgttcggtaaacgtcgggacctacgggtcctaaccgtcgtaagtcctacgacccgaacggtaccccaacccgctccg

SEQ ID NO: 340778 - DNA, 645 bp, Homo sapiens
  misc_feature: GZ8MTXP02JN5VN.11.59.F04.1.454.CMB.2.raw
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgttctctatgatgtcactaacgcggcctcgaggacgtccctgatcgtattctctggcctaccgaagtctggaccaaccgaccggtccccctcccgtagaacctacttctacgtcgggccttcccgaggtcctaggaggtatcggagggtctagtaatttattagttgtcctgtcctactaagttagtacgggtaaactttaccccttactttctttttccgtaccgttacgggtaaccgttcgggaaccctacgggttccctaacccggttctaacgggtcctaacggaccccgtaaaacggccccctaaaccccgtctccggtacctaccttcctacccgttccccaacccttccgtactactccctcgttcccgtacggtacgg

SEQ ID NO: 340779 - DNA, 539 bp, Homo sapiens
  misc_feature: GZ8MTXP02JGT59.11.59.F04.1.454.CMB.2.raw
  modified_base (387)..(387): a, c, t, g, unknown or other
  misc_feature (387)..(387): n is a, c, g, or t
  modified_base (444)..(444): a, c, t, g, unknown or other
  misc_feature (444)..(444): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccatccctgcactggaaccagcaatgatgttggtcgttataagtatgtctcatggtaccgcacgaacccaggacaaacgcccccaagtccgtctctatgatgtacacgtaacgccggcctcgaggtcgtcctgactcgattctcgtgcctacagtctggacacacggcctacctgaaactntctcgtgggtcctccgagcgtagaggatgacgtgtagtattagttattgcttgactntatagtacgtacttactcttctttcgtcgttacgacgtcggacctacgtactaccgacgtaacgacaacgacccgaacgaccccaaccgtctacg

SEQ ID NO: 340780 - DNA, 536 bp, Homo sapiens
  misc_feature: GZ8MTXP02FYR9V.11.59.F04.1.454.CMB.2.raw
  modified_base (360)..(360): a, c, t, g, unknown or other
  misc_feature (360)..(360): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaaacgcccccaagtcgtctctatgatgtcactaagcgccctcagacgtccctgactcgattctctgctccagtctggcaacnccgcctccctgaactatctcgtggctccgaggctagaggatgagctgattattattgctgctcatagtaggaataccttattcttttactcgtttacggaaccgttgggaaccctacgggtacctaccgttcctaacggtcaaccggaccccaacggacccaaacccccgataccg

SEQ ID NO: 340781 - DNA, 614 bp, Homo sapiens
  misc_feature: GZ8MTXP02HMH4V.11.59.F04.1.454.CMB.2.raw
  modified_base (265)..(265): a, c, t, g, unknown or other
  misc_feature (265)..(265): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatccctgcactggaaccagcaatgatgttggtcttataagtatgtctcatggtaccggnagaacccaggcaaacgccccccaagtcgttctctatgatgtcactaagccggcctgaggacgtccctgactcgattcctctcggcctaccagtcctaggaccaaccgaccggtccctcccgtagaacctatcctcgtcggggccttcccgaggtcctaggacggtagtgagggtctaggtaatttagtttagttggtcttgtcttactaagttagttagggaactttaccgttaactttccttttcttaccgtttacggtaaacgttcggggaccctacgggttcctaacccggttcccgttaaggtccgaaccgaccccgaaaacggccccctaaaccctacgttccg

SEQ ID NO: 340782 - DNA, 556 bp, Homo sapiens
  misc_feature: GZ8MTXP02G8UOX.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgccccccaagtcgttctctatcgatgtcactaagcggccctcaggagtccctgactcgattctctgctcagtctggcaacacgcctcctgaacatctcgtgggctccgaggcctggacggatgaggtctggtattatttatgtctgctcatagtacggtaactaccttacttcctttttctcgtttacggaaacttcgggaaccctacgggtaccctaacccggttccgtaaggtcccaacggaccccaaacggtacccccaaccccgtacttccg

SEQ ID NO: 340783 - DNA, 571 bp, Homo sapiens
  misc_feature: GZ8MTXP02IZLW2.11.59.F04.1.454.CMB.2.raw
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggacaaacgccccccaagtcgttctctatgatgtacactaacgccgccctcgaggactccctgactcgattctctggctcagtcnggaccacgaccgcctccctagaaccntctcgtggcctcgagctgagntgagctgtattntatgctagcctanatagtacggtaaacttacccttacttcctttttacgtcgtttaccgggaaacgtcggggtaaccctacggggttccctaacccggttccgtaacggtaccaaccggaccccgaaacggaccccctaaccccgacttacccg

SEQ ID NO: 340784 - DNA, 540 bp, Homo sapiens
  misc_feature: GZ8MTXP02IBTUD.11.59.F04.1.454.CMB.2.raw
  modified_base (172)..(172): a, c, t, g, unknown or other
  misc_feature (172)..(172): n is a, c, g, or t
  modified_base (475)..(475): a, c, t, g, unknown or other
  misc_feature (475)..(475): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttataagtatgtctcagtggtaccggcaacgaacccaggaccaaacgccccccaaagtcgttctctatgatgtcactaaagcggcctcaggagtccctgactcgtattctctggctccgagtctggacaaccgaccggcctaccctgaaactactcttctcggggctcccgaggtcctaggaggagtcgaggctagtattagttattgctgctcatatggaactctactctttcncgtttcgaacttgggacctacggtcaaccgtccgaagtccaacgcccaaggcccaaccctactcg

SEQ ID NO: 340785 - DNA, 569 bp, Homo sapiens
  misc_feature: GZ8MTXP02FI8GB.11.59.F04.1.454.CMB.2.raw
  modified_base (445)..(445): a, c, t, g, unknown or other
  misc_feature (445)..(445): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagcggccctcaggatcccctgactcgatctctgctcagtctggacaacgaccgtcctccctagaactatcctcgtcgggcctccgaggctaggacggtatggaggtctagtaatttatttagttgctgccttanattagtacggaacgttaccttactttcttttctacgtttacggaaacgtcgggaaacctacgggttaccaccgttaccgtaaggtccaacggaccccaacggaccccaaaccccgtacttaccg

SEQ ID NO: 340786 - DNA, 559 bp, Homo sapiens
  misc_feature: GZ8MTXP02FTQCC.11.59.F04.1.454.CMB.2.raw
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagccgcctcaggactccctgactcgattctctggcctcagtctggacaacnccgcctccctgaacntctcgtgggctccgaggctaggacgtatgaggtctagtatttattagttgcttgcctatagtagtaggtaacttaccttactttcttttctacgttacggtaacgtcgggaccctacgggtaccaccgttaccgtaacggttccgaacggaccccaaacggcccccaaaaccccgtctaccg

SEQ ID NO: 340787 - DNA, 521 bp, Homo sapiens
  misc_feature: GZ8MTXP02FRI2Q.11.59.F04.1.454.CMB.2.raw
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (515)..(515): a, c, t, g, unknown or other
  misc_feature (515)..(515): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaaacgccccccaagtcgttcnctatgatgtcactaagcggcctnagatccctgatcgattcnctggctcagtctggcaacacgcctcctgaaacntctcngggctccgaggctgaggntgaggctagattattattgctgcctanatataggaatacctacttcttttctctttacggaacttcgggacctacggtccaaccgtcctaaggtcacggacccaacgcccaaaacccncttacg

SEQ ID NO: 340788 - DNA, 543 bp, Homo sapiens
  misc_feature: GZ8MTXP02I76NM.11.59.F04.1.454.CMB.2.raw
  modified_base (423)..(423): a, c, t, g, unknown or other
  misc_feature (423)..(423): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgccactggaaccagcaatgatgttggtcgttataagtatgtctcatggtaccggcagaacccaggcaaacgccccccaagtcgtctctatgatgtcactaagcggccctcaggactccctgactcgattctctgcctcagtctggcaacacgcctcctgaacatctctggctccgaggctgacggatgagctgtattattattgcttgctnatagtaggaacgtacctattccttttctacgtttaccggaacttcggggaacctccgggtacctacccgttaccgtaacggtccaacggtaccccaacggaccccaaccccgtacttccg

SEQ ID NO: 340789 - DNA, 548 bp, Homo sapiens
  misc_feature: GZ8MTXP02F9BED.11.59.F04.1.454.CMB.2.raw
  modified_base (223)..(223): a, c, t, g, unknown or other
  misc_feature (223)..(223): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccngcaatgatgttggtcttataagtatgtctcatggtaccgcacgaacccaggaccaaacgcccccaagtcgttctctatgatgtcactaagccggcctcgagacgtccctgactcgattctctggctcagtcnggcaacncgcctcctgacatctcgtggctccgagctgacgtagtcgaggtctagaactttagttattgctagcttacgtatagtaggtaacgttaccttactttcttttactcgttacggaaacgttcgggaaccctacgtaccacccggttcctaaggtccacgaccccaacggtacccaacccgacttccg

SEQ ID NO: 340790 - DNA, 654 bp, Homo sapiens
  misc_feature: GZ8MTXP02F127G.11.59.F04.1.454.CMB.2.raw
  modified_base (143)..(143): a, c, t, g, unknown or other
  misc_feature (143)..(143): n is a, c, g, or t
tcagcgagagataccacgaccggtgctcgatttagtacacacacttagggattggggggctttgcctgggctctgctccttcctcagtcctcctcactcagggcacaggatcctgggctcagtctgccctgactcagccccgntctagtgtccgggtctcctgggcagtcagtcaccatcccctgcactggaaccagcaagtgatggttcggtcgttataagtatgtctcatggtaccgcagaacccaggcaaacgcccccaagtcgtctctatgatgtcactaagccggcctcgagggacgtcccgtgactcgattctctggctccgaagtctggacaactccggcccctccctagaactctctcgtgggcctccgaggctggacgatcgagctagtaattattattgcttgacttacaatagtacgggaacttacccttaactttcgttttaccgtacgttaccgggaaacgttcggggaaccccttacggggttccctaacccggttaccgtaacgggtccctaacggacccccgtaaaacgggccccctaaaaccccgtcttacggtaccctaacctttcccgttccgtttacccccaaccccgtttccgttacgttaccttccgttaccgtaccggtccgttaacgggg

SEQ ID NO: 340791 - DNA, 525 bp, Homo sapiens
  misc_feature: GZ8MTXP02GUT82.11.59.F04.1.454.CMB.2.raw
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttgtcttataagtatgtctcatggtaccgcagaccaggcaacgcccccaagtcgtctctatgatgtcactaagcgcctcaggacgtcctgactcgattctctcggctcagtctgcacaccgctcctgaaacntctcncgggctccgagctgagatgngctgattattatgtactgctcagtatacggaagttaccttacttcttttactcgttacggtactacggggacctacggtacccgtaccgttaccgtaagttccgacgtacccgaacggacccaaccccgactccg

SEQ ID NO: 340792 - DNA, 542 bp, Homo sapiens
  misc_feature: GZ8MTXP02I3XF3.11.59.F04.1.454.CMB.2.raw
  modified_base (263)..(263): a, c, t, g, unknown or other
  misc_feature (263)..(263): n is a, c, g, or t
  modified_base (367)..(367): a, c, t, g, unknown or other
  misc_feature (367)..(367): n is a, c, g, or t
  modified_base (408)..(408): a, c, t, g, unknown or other
  misc_feature (408)..(408): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcttataagtatgtctcatggtaccgnagaacccaggacaaacgccccccaagtcgttctctatgatgtcactaagccggccctcaggacgtccctgactcgattctctggctccagtctacggacaaccnccggcctaccgtagaacatctcgtgggcctcgagctgagtngagctgtattagttattgcttgctacatagtaggaacgttacctacttcgttttctcgttcggtaaactggggacctacggtaccctacgtccgtaacggtcacgacccgaaggccctaaaacccctacttccg

SEQ ID NO: 340793 - DNA, 810 bp, Homo sapiens
  misc_feature: GZ8MTXP02IJJWH.11.59.F04.1.454.CMB.2.raw
tcagcgagagataccacgaccggtgctcgatttagtacacacacttagggattgggggctttgcctgggctctgctcctcctcagcctcctcactcagggcacaggatcctgggctcagtctgccctgactcacgcccgctcagtgtccgggtctcctgggcagtcagtcaccactccctgcactgaaccagcaatgatgttggtcttaataagtatgtctcagtggtaccgcagaacccaggacaaaccgcccccaagtccgttctctatgatgtacaacgtaagccggcccctacacggtactcccctgactcgtattctacgtggctccgaagtctacggacctaaaccgaccggtccccctacccgtacgaacctacgtcccgtcggggccttccgacgggccttggaacgggtatcggaagggtccttaggttaatttaagtttagttcggtcttcggtacccttacgtaaagttaacggtaacgggtaaaacgtttaccctttaaccgttttccctttttaccgtttaccggtttaacgggtaaaaccggtttccgggggaaaaccccgttaacccggggttaacccgtaccccgggtttacccggtttaaacgggtacccgtaaccgggtaacccccgaaaaccggggtaacccccctaaaaccccccgtcggtttaccccgttaccctaacccggtttcccccttaccccggtttccccccggttacccccgttccccgtttaacccggttacccgtttccccttacccgtttacccggtaccggtttcggaaccccggggg

SEQ ID NO: 340794 - DNA, 521 bp, Homo sapiens
  misc_feature: GZ8MTXP02FOK12.11.59.F04.1.454.CMB.2.raw
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaacgccccccaagtccgttctctatgatgtacactaagcggccctnaggatccctgactcgattctctggctcagtctggcaacncgcctccctgaacatcctctggctcgagctgacgatgaggctagtatttatattgctntcctntatagtggaaacttaccttacttctttctcttacggactcgggacctacggtcacccgtcgtaaggtcacgacccgaaggaccccaaccactccg

SEQ ID NO: 340795 - DNA, 541 bp, Homo sapiens
  misc_feature: GZ8MTXP02IO73M.11.59.F04.1.454.CMB.2.raw
  modified_base (173)..(173): a, c, t, g, unknown or other
  misc_feature (173)..(173): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgcactgactcacgccccgntcagtcgtccgggtctccgtgggcagtcagtcaccatcccctgcactggaaccagcaatgatgttgtcgttataagtntgtctnatggtacgcagaacccaggcaaacgcccccaagtcgttctctatgatgtcactagcgccctnagatcctgatcgattctctggcctccgtaagtctggaccaaccgcggccctccctagaacactctcgtcgggtcctcgagggtctggaaggatggaaggtcttagtatttattattgctgctacatagtggtaaacgtccttactttctttctcgttacggaaactcgggacctacggtctaaccgtccgtaggtccacgacccaacggtcccaaaccctcg

SEQ ID NO: 340796 - DNA, 534 bp, Homo sapiens
  misc_feature: GZ8MTXP02FO0K6.11.59.F04.1.454.CMB.2.raw
  modified_base (172)..(172): a, c, t, g, unknown or other
  misc_feature (172)..(172): n is a, c, g, or t
  modified_base (363)..(363): a, c, t, g, unknown or other
  misc_feature (363)..(363): n is a, c, g, or t
  modified_base (429)..(429): a, c, t, g, unknown or other
  misc_feature (429)..(429): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttataagtatgtctcatggtaccggcagaacccaggacaaacgccccccaagtcgtctctatgatgtcactaagccggccctcaggatccctgactcgattctctggctccagtctggcaacnccgcctccctgaaactatcctcgtcgggctccgaggctggaggatgagctgatttatatgctgctnatatggaactacctacttctttctcgttacggaacgtcgggaaccacggttccacccgttacctaaggtccaacgtaccccgaaggtaccccaaccccactaccg

SEQ ID NO: 340797 - DNA, 531 bp, Homo sapiens
  misc_feature: GZ8MTXP02HA162.11.59.F04.1.454.CMB.2.raw
  modified_base (233)..(233): a, c, t, g, unknown or other
  misc_feature (233)..(233): n is a, c, g, or t
  modified_base (264)..(264): a, c, t, g, unknown or other
  misc_feature (264)..(264): n is a, c, g, or t
  modified_base (343)..(343): a, c, t, g, unknown or other
  misc_feature (343)..(343): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgnagaacccaggcaaacgcccccaaagtcgttntcccctatcgatgtcactaagcggcctcaggagtccctgatcgattctctggctccaagtctgcaacacggcccctccngaacatctctgggctcaggctgagatgagctgattatattgctgctcatatagggaatacctaacttctttcttcgttcggaacttgggaccctacgtccaaccgtcctaggtcgacgacccgaaacggcccaaaccctctacgtctacctcctcgtcccgccctcctcgtactctcctcggctacgg

SEQ ID NO: 340798 - DNA, 558 bp, Homo sapiens
  misc_feature: GZ8MTXP02JR5IB.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcgttataagtatgtctcatcggtaccgcacgaacccaggacaaacgccccccaagtccgttctctatgatgtcactaagccggccctcgaggactccctgactcgacttctctggcctaccagtctcggaccaaccgccggccctaccctagaaacctactctcgtcgggcctccgaggtcctaggaggatggaggtctagtatttattattgctgctcagtagtaggtaacttacctactttcttttcgtcgttacggacgtcgggaccctacggtcctaccgtcgtaaggtccacgacccaacgaccccaacccactcg

SEQ ID NO: 340799 - DNA, 546 bp, Homo sapiens
  misc_feature: GZ8MTXP02IKK5I.11.59.F04.1.454.CMB.2.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctnatggtaccggcacgaacccaggacaaacgccccccaagtccttctctatgatgtcactaagccggccctcgacggtacgtccctgactcgattctctcggcttcagtctggacaccnccggcctcctagaacntctcgcgggctccgaggctgaggntgagctagtaattagttattgctgctacatagtggtaattaccttacttcttttactcgttacggacttacgggacctacggtcctaccgtaccgtaacggtccacggaccctaacggcccctaacccgactccg

SEQ ID NO: 340800 - DNA, 589 bp, Homo sapiens
  misc_feature: GZ8MTXP02JZCUE.11.59.F04.1.454.CMB.2.raw
  modified_base (366)..(366): a, c, t, g, unknown or other
  misc_feature (366)..(366): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggaccaaacgccccccaagtccgttctctatgatgtcactaagccggccctcaggacgtccctgactcgattctctgctcagtctggacacnccgcctcctagaacatctcgtcgggcctcccgaggcctaggacggagtcggaagggtcttaggtaatttagttattggcttgcctagtaattagtacggtaacgttaccttacttcctttttactaccgtttacgggtaacgtacgggtaccctacgggttccctaccggttcccgtaacggtcccacggaccccgaacggtccccaaacccccgtacttccg

SEQ ID NO: 340801 - DNA, 501 bp, Homo sapiens
  misc_feature: GZ8MTXP02JF5RA.11.59.F04.1.454.CMB.2.raw
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (460)..(460): a, c, t, g, unknown or other
  misc_feature (460)..(460): n is a, c, g, or t
  modified_base (495)..(495): a, c, t, g, unknown or other
  misc_feature (495)..(495): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgtctctatgatgtcactagcggccctcaggcgtcctgactcgattctctgctcagtctgcacncgctccnacntcntggctcngctgagatgngctgtattattatnctgctcatagtggtaacttaccttacttctttctcgtttacggaactcgggaacctcgtacnccgtcgtaaggtcacgtacccgacggcccaacccnctaccg

SEQ ID NO: 340802 - DNA, 544 bp, Homo sapiens
  misc_feature: GZ8MTXP02JTOBI.11.59.F04.1.454.CMB.2.raw
  modified_base (224)..(224): a, c, t, g, unknown or other
  misc_feature (224)..(224): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccgcagaaccaggacaacgcccccaagtcgtctctatgatgtcactaagcgccctcagacgtccctgactcgattctctgctcagtctggcacacggcctcctgaacatctcgtcgggcctcgaggcctagaggatagaggtctagtatttattagttgctgctcgatagtaggtaacttacctacttccttttactcgttacggacgttacggacccgtacggtcctaacccggtccgtaagggtaccacggacccccaaggacccccaaccccgacgttccg

SEQ ID NO: 340803 - DNA, 663 bp, Homo sapiens
  misc_feature: GZ8MTXP02F0SN5.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccactcccctgcactggaaccagcaatgatgttggtcgttataagtatgtctcagtggtaccgcaagaacccaggaccaaacgcccccaagtcgttctctatgatgtcaactaacgccgaccctcgagacgtcctgactcgtattctctggcctaccagttcgtacggaccaaaccgtcccgggtccctacccgtagaaacctacttccgtcgtcgggaccctcccgacgggtccgttaggaggtagtacgggacggtaccgttaggtaaatttagtttaacgttcgtcgttacgtccttacaagttaacgtacgggtaaacttaacccgtttactttccttttaccgtacgtttaccgggaacgtaccgggtaacccgttaccggtaccgtacccgttaccgtaacgggtccaacccggtaaccccgaaaccggaccccctaaacccgtcctttaccg

SEQ ID NO: 340804 - DNA, 550 bp, Homo sapiens
  misc_feature: GZ8MTXP02IFP68.11.59.F04.1.454.CMB.2.raw
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggccaaacgcccccaagtcgttctctatgatgtcactaagcggccctcaggacgtccctgatcgattctctggctccaagtctggcaacacggcccctccctgaacatctctcgggctccaggctgagntgagctgattatntgctgctanatagtagtacttaccttactttctttctcgttacggtacgtcggacctacggtctaccgtcgtacggccacgacccgaacgacccaaccctacttacgtacctaccttccgttccgttccccgtcccttccttacgttactccttccgtcgtcgtcgg

SEQ ID NO: 340805 - DNA, 558 bp, Homo sapiens
  misc_feature: GZ8MTXP02FQAJP.11.59.F04.1.454.CMB.2.raw
  modified_base (437)..(437): a, c, t, g, unknown or other
  misc_feature (437)..(437): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaaacgccccccaagtccgttctctatgatgtcactaagccggccctcaggagtcccctgactcgattctctggcctcagtctggcaacacggcctccctgaacatctcgtgggcctccgaggctgaggatggaggctgtatttacttattgctgtcctnatagtggaacttaccttacttcttttctcgtttacggaacgttcggggaccctaccgggttaccaacccggttcctaagttcgtaccgacgaccccgaaacggtccccaaacccccgtacg

SEQ ID NO: 340806 - DNA, 566 bp, Homo sapiens
  misc_feature: GZ8MTXP02GDINZ.11.59.F04.1.454.CMB.2.raw
  modified_base (373)..(373): a, c, t, g, unknown or other
  misc_feature (373)..(373): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccgcagaacccaggacaaacgcccccaagtcgtctctatgatgtcactaagcggcctcaggacgtccctgactcgattctctgctcagtctggacaacacgcctcctgaactntctctggctccaggctagaggatgaggtctgaatttagttatgtactgcctacattagtacggtaaacttacccttacttcctttttcgtcgtttacgggtaaacgttcggggtaaccctaccgggttacctacccggttacctaagggtcccaacggtaccccgaaacggaccccaaaccccctacgtaccg

SEQ ID NO: 340807 - DNA, 671 bp, Homo sapiens
  misc_feature: GZ8MTXP02HZXKT.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatgttggtcgttataagtatgtctcagtggtaccgcaacgaacccaggacaaaccgcccccaagtcgttctctatgatgtcaactagccggccctgaggtacgtccctgactcgtacttctcgtggccttcagtctcggaccaaccgtaccggccctacctagaacctatcctcgtacgggcctaccgaggccgtaggacggagtgacggtacttagtaaattttactttagttcgtacgttacgtactacgttaagtttaacgtaacgggttaaaccgtttaaccctttaaccttttccgttttttaccgtttaccgtttaaccggggtaaacgttccgggggtaaaccccgtaccgggtttaccctacccggttaccgtaacggtacccgtaaccggacccccgtaaaacggccccctaaaaccccgtacgtttcccg

SEQ ID NO: 340808 - DNA, 525 bp, Homo sapiens
  misc_feature: GZ8MTXP02IPZYF.11.59.F04.1.454.CMB.2.raw
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (449)..(449): a, c, t, g, unknown or other
  misc_feature (449)..(449): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaagccccccaagtcgttctctatgatgtcactaagccggccctcaggactccctgactcgattctctgctcagtctggcacacggcctcctgaacntctcngggctccgaggctgagatgaggctgtattattattgctgcttcatataggaagttacctacttctttttacnccgtttacggaacttcgggacctacggtacctaccgtcctaaggtccacgccccaaggccctaaccccgacttccg

SEQ ID NO: 340809 - DNA, 508 bp, Homo sapiens
  misc_feature: GZ8MTXP02HY359.11.59.F04.1.454.CMB.2.raw
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaagccccccaagtcgtctctatgatgtcactaagcggccctcaggagtccctgactcgattcnctggctcagtctgcacacgccncctgacatctcngggctccgaggctgacggatgagctgattattatgctgntcatatggaaagtctacttctttactctttcggaacttcgggacctacggtcaccgttcctaaggtcacgtccaacggcccaacccgacttccg

SEQ ID NO: 340810 - DNA, 552 bp, Homo sapiens
  misc_feature: GZ8MTXP02IB6ED.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttaataagtatgtctcagtggtaccgcacgaaccaggacaaacgcccccaagtcgttctctatgatgtacactaagcggcctcgaggactccctgactcgtatctctcggctcagtctggacacgaccgtcctacctagaaacctatctcgtcggctcccgagctagacgagtgagctagtattattatgctgctacatagtacggaaacttacctacttcttttctaccgtttacggaaacttcggggacctaccgggtcctaaccggtcctaacggtcaacgacccgaaacggccccaaacccgtactccg

SEQ ID NO: 340811 - DNA, 654 bp, Homo sapiens
  misc_feature: GZ8MTXP02HYEU8.11.59.F04.1.454.CMB.2.raw
  modified_base (208)..(208): a, c, t, g, unknown or other
  misc_feature (208)..(208): n is a, c, g, or t
  modified_base (332)..(332): a, c, t, g, unknown or other
  misc_feature (332)..(332): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtccacnctcctgcacgtacgaaccagactaagtagtagttggttggttacttaagttaagtatcgtctacgtagtcggtaccgacaaccgaaccgagaaccaacccgaccccgtaagttccttctactangtatcgtacaacgtaacgccggtcctacggaacggtccgtccgtagaccgtcgtactttcgtcgtcgtacctacgtacgtcgtacgaccaaacccgtcccgtccccttacccgacggtaccctaacgtcgtacggtcgggtcccacgtacgtcgtagtacgagtagtaggaggtcttagttaactttacgttagttggtcgacgagacgtaggtggtagaccgaaccgtaaccgtaggtacgtttcggtacgtttggttacgggtttcgggttcgggacggacggtaacgtacgtcgtccgtaacgtcgtacgtacgaccgg

SEQ ID NO: 340812 - DNA, 683 bp, Homo sapiens
  misc_feature: GZ8MTXP02G1BO3.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccactcccctgcactggaaccagcaatgatgttggtcgttaataagtatgtctcagtcggtaccggcaacgaacccaggaccaaaccgccccccaagtccgttctctatgatgtacactaacgccggccctacgacggtacgtccctgacctcgtacttctctcggcctacagtctacggaccaaccgtccggccctaccctagaaacctcttccgtcgtcgggcctacccgaggtccgtaggacggtatgggacgtcttagtaatttagtttattcggtctcgtaccttataagttagtaacgggtaacctttacctttactttcctttttaccgtaccgtttaccggggtaaaccgttcgggggtaaaccccttaccggggttacccgtaacccggtttacccgttaaccgggttacccgaaacccggtacccccgtaaacccggaacccccctaaacccccggttactttacccgg

SEQ ID NO: 340813 - DNA, 671 bp, Homo sapiens
  misc_feature: GZ8MTXP02G1FGC.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgattgttggtcgttataagtatgtctcagtggtaccggcacgaacccaggaccaaacgcccccaagtccgtctctatgatgtacactaacgccggtccctcgacggtacgtccctgactcgtattctcgtcgcctcagtctacggacctaaccgaccggtccctaccgtacgaaacctcttccgtcgtcgggcctcccgaggtcctaggacggtagtaggacggtctaggttaatttagtttacgttcgtcgttcgtaccttacgtaagtttacgtaacggttaaaccgtttaaccctttactttccgtttttaccgtaccggtttaaccgggtaaccgttccgggggaaccccttaacgggtacccctaacccggttacccgtaacggtacccgaaccggtaccccgaaccggaccccctaacccctaacgtttcccg

SEQ ID NO: 340814 - DNA, 494 bp, Homo sapiens
  misc_feature: GZ8MTXP02HGHH3.11.59.F04.1.454.CMB.2.raw
  modified_base (140)..(140): a, c, t, g, unknown or other
  misc_feature (140)..(140): n is a, c, g, or t
  modified_base (233)..(233): a, c, t, g, unknown or other
  misc_feature (233)..(233): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (410)..(410): a, c, t, g, unknown or other
  misc_feature (410)..(410): n is a, c, g, or t
  modified_base (483)..(483): a, c, t, g, unknown or other
  misc_feature (483)..(483): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttataagtatgtctcatggtaccgnagaacccaggcaaacgcccccaagtcgtctctatgatgtcactaagcgcctcaggagtccctgatcgattctctggctccaagtctggacaacacgcccctaccctgaacntctcngggcctccgaggctgagatgagctgattatatgctgctcatatgaatacctattctttctntcgactggacagtcacgtctagtcagcccaagccaacccactcgacacgtctacgttccccaacctctacgtntcctctcgctg

SEQ ID NO: 340815 - DNA, 557 bp, Homo sapiens
  misc_feature: GZ8MTXP02JOQLH.11.59.F04.1.454.CMB.2.raw
  modified_base (359)..(359): a, c, t, g, unknown or other
  misc_feature (359)..(359): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgttctctatgatgtcactaagcggcctcaggactccctgactcgattctctgctcagtctggcacncggcctcctgaactatcctcgtgggcctcgaggcctggacgatgaggtctgtattattattgctgcttcatagtaggtaaacgttaccttacttctttttccgtcgtttacggtaaccgttcgggtaaccctacgggtcctaacccggtccgtaacggttccaacggtccccaaaggtccccaaaccccgtacttccg

SEQ ID NO: 340816 - DNA, 505 bp, Homo sapiens
  misc_feature: GZ8MTXP02FMW3D.11.59.F04.1.454.CMB.2.raw
  modified_base (421)..(421): a, c, t, g, unknown or other
  misc_feature (421)..(421): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaagcccccaagtcgtctctatgatgtcactaagcggccctcaggatcccctgactcgatctctggctccagtctggcaacacggcctccctgaaacatctctgggctccctagctgaggatgaggctgattatattgctgctanatatagatacctacttctttctcgttacgacgtcggacctacgtccaccgtaccgtaagtcacgaccacgacccaaccctctcg

SEQ ID NO: 340817 - DNA, 556 bp, Homo sapiens
  misc_feature: GZ8MTXP02H0XHI.11.59.F04.1.454.CMB.2.raw
  modified_base (436)..(436): a, c, t, g, unknown or other
  misc_feature (436)..(436): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaaacgccccccaagtcgttctctatgatgtcactaaagccggccctcagacgtccctgactcgattctctggctccagtctggctaacaccggtcctccctagaacatctcgtgggcctccgaggctgagatgaggtctgtaattattattgctgctnatagtaggaattacctacttcttttactctttacgggaaactggggtaaccctacgggtactacccggtactaacgggttcaacggcccccaaaagggaccccctaaacccgaccttccg

SEQ ID NO: 340818 - DNA, 602 bp, Homo sapiens
  misc_feature: GZ8MTXP02HI657.11.59.F04.1.454.CMB.2.raw
  modified_base (480)..(480): a, c, t, g, unknown or other
  misc_feature (480)..(480): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgccccccaagtcgttctctatgatgtcactaagcggccctcgaggacgtcccctgactcgtattctctggctcagtctggacaacacgcctccctagaactatcctcgtcggggcctcccgaggtcctagacggatggaagtctgtaattattattgctgctactaatagtacggtaacttaccttacttctttttaccncgttttacgggaaccgttacgggggaacccctaacggggttcccaaccccggttaccgtaacgggttacccaaccgggtacccccaaaacggggtacccccaaaacccccgtacctttccgg

SEQ ID NO: 340819 - DNA, 516 bp, Homo sapiens
  misc_feature: GZ8MTXP02F94FP.11.59.F04.1.454.CMB.2.raw
  modified_base (367)..(367): a, c, t, g, unknown or other
  misc_feature (367)..(367): n is a, c, g, or t
  modified_base (469)..(469): a, c, t, g, unknown or other
  misc_feature (469)..(469): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgttctctatgatgtcactaagcggccctcaggacgtccctgatcgattctctggctcaagtctgcaacacggcccctcctgaacatctctgggctccaggctgagntgagctgattattattgctgctcatataggaacttaccttacttcttttctcttcggaactcggaccacggtcaccgtcagtcacgcccacggcccaacccnctcgacacctctcgttccccgccctaccgtcgtactctctcgctcgg

SEQ ID NO: 340820 - DNA, 838 bp, Homo sapiens
  misc_feature: GZ8MTXP02HK9TF.11.59.F04.1.454.CMB.2.raw
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgtctctatgatgtcactaacgccggccctcgaggacgtccctgatcgtatttccgtctcggccttcccgaagttccgtcgggaccaaaccgtaccgggtccccccttacccccgttaggaaaaccctactttcccgtccggttcgggggtcccttaccccgggaaggggtcccgttaggggaaggggtaacgttggggaacgggtccgttaaggtaaacgtttttaatttaacgtttcgggtcccttacgggtccctttacctaaacgtttaaggttacgggggtaaaaccgttttaaccccctttaaaccggtttttaccctttttttcccgtttacccggtttacccggggtaaaccgggtttccggggggaaaccccccttaaaccgggggtttccccctaaacccccgggttttcccggttaaaccggggttcccgtaaaccgggtaccccccgtaaaacggggcccccctaaaacccccgtaacgttccggtacccctaccgtttcccgttaaccgtttccccccaaccccgtttcccttaaccgttacttccctccgttccggtcttacgggg

SEQ ID NO: 340821 - DNA, 617 bp, Homo sapiens
  misc_feature: GZ8MTXP02F0OP0.11.59.F04.1.454.CMB.2.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (474)..(474): a, c, t, g, unknown or other
  misc_feature (474)..(474): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactccctgcactggaaccagcaatgatgttggtcttaatagtatgtctnatggtaccgcacgaaccagacaacgcccccaagtcgtctctangatgtacactaacgccgcctcgacgtacgtccgtgactcgtattctctcggctactagtctacggacaaccgccgccctaccgtagaaacctacttcctcgtcgggccttaccgacggccgttaggacggtataggacgtacgttagtaatttagttattcggtactcgccttanagttaaggtacggtaaaccttacctttactttccgttttacctacgttacggttaaaccgtcgggtaaccctaccggttaccctaacccgttccggtaagtccgaaccgtacccgaaccggtaaccctaaccccgattacccg

SEQ ID NO: 340822 - DNA, 552 bp, Homo sapiens
  misc_feature: GZ8MTXP02ILC1K.11.59.F04.1.454.CMB.2.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcacgaacccaggacaaacgccccccaagtcgtctctatgatgtcactaagcggccctcaggctcctgactcgattctctggctcagtctgcacncgctccnacntctcncggctccgaggctgagangagctagatttattattgactcgtcctatattataggtaacttacctactttcttttacctcgttacggaaccgtcgggtaaccctacggttaccctaccgtacccgtaagggtcccaaccggtaccccgaaacggtaccccctaaacccctacgttccg

SEQ ID NO: 340823 - DNA, 624 bp, Homo sapiens
  misc_feature: GZ8MTXP02GVE9L.11.59.F04.1.454.CMB.2.raw
  modified_base (447)..(447): a, c, t, g, unknown or other
  misc_feature (447)..(447): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcagccccgctcagtgtccgggtctcctgggcagtcagtcaccatcccctgccactggaaccagcaatgattgttggtcgttataagtatgtctcatggtaccggcagaacccaggacaaacgcccccaagtcgttctctatgatgtcactagccgcctcaggactccctgactcgattctctgctccagtctggacaaccaccggcctccctagaactactctcgtcgggctccgaggcctaggacgatcgaggtctgtaatttagttattcgcttgccttanaagttagtacgggtaaacttaccctttaactttcctttttaccgtaccgtttacgggtaaaaccgttccggggtaaaccccgttaccgggttaccctaaccccggttacccgtttaacgggtaccctaaccggaacccccgaaacggtacccccaaaacccccggtactttacccgg

SEQ ID NO: 340824 - DNA, 582 bp, Homo sapiens
  misc_feature: GZ8MTXP02G46OJ.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgattggttggtcgttaataagtatgtctcagtcggtaccgcacgaacccaggacaaaccgcccccaagtcgttctctatgatgtacactacgccgtcctcgaggactccctgactcgattctcgtcggcctacagtcctaggaccaaccgaccggtccctacctacgaaacctacttccgtcgtcgggcctcccgaggtcgtaggaggatcggaggtactagttaattattagtcgcttgactacagttagtacggtaacttaccttatttcctttactacgttacggaacgttcggaacctacggtccaccgttctaaggtccacgacccacggaccccaccgactacg

SEQ ID NO: 340825 - DNA, 546 bp, Homo sapiens
  misc_feature: GZ8MTXP02JETE5.11.59.F04.1.454.CMB.2.raw
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (402)..(403): a, c, t, g, unknown or other
  misc_feature (402)..(403): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatggttggtcttataagtatgtctcagtcggtaccgcaacgaacccaggaccaaaccgcccccaagtccgttctctatgatgtcacgtagccggcctcgaggactcctgactcgattctctgctcagtctggacacncggcctccagaacntccncgtggctcgagcngagnngnggctgtattatntgntgctnatagtagtaactaccttacttctttactcgttacggtaacgtcgggtacctacgggttaccctaccgttaccgtaacggtaccgtaccgacccgtaacggaccccctaacccgtactaccg

SEQ ID NO: 340826 - DNA, 621 bp, Homo sapiens
  misc_feature: GZ8MTXP02GFIVX.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtcttataagtatgtctcatggtaccggcacgaacccaggacaaacgcccccaagtccgtctctatgatgtcactaagccgcctcgagacgtcctgactcgtatctctgcctacagtctaggacaaaccgccgcctcctagaaacactccgtcgtcggctcccgagcgtgaagggtagtaggaggtacttagttaatttattagttgtcttagtaccttagtaagttaagtaacgtaacgttaccctttactttccttttacgttaccgttaaccgggtaaacgtaccgggtaacccgtaccggttaacccgtacccggttaccgtaaccggtaccgaaacccggacccccgaaaccggtacccccaaaccccgtacgttccg

SEQ ID NO: 340827 - DNA, 620 bp, Homo sapiens
  misc_feature: GZ8MTXP02IC2BP.11.59.F04.1.454.CMB.2.raw
  modified_base (233)..(233): a, c, t, g, unknown or other
  misc_feature (233)..(233): n is a, c, g, or t
  modified_base (383)..(383): a, c, t, g, unknown or other
  misc_feature (383)..(383): n is a, c, g, or t
  modified_base (597)..(597): a, c, t, g, unknown or other
  misc_feature (597)..(597): n is a, c, g, or t
  modified_base (606)..(606): a, c, t, g, unknown or other
  misc_feature (606)..(606): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgnagaaccccaggaccaaacgccccccaagtcgttctctatgatgtcactaagccgcctcgaggactccctgactcgattctcgtcggctaccaagtctggaccaacgacggtcccctcctagaactatctcgtgggcctcgagctgacgtngacggcttgaatttacttagttgcttgcttacgatagtgtaaacgtacccttagtttccttttcgttcgttaccggtaacgttcgggaccctacggtacctacccggttcgtacggttccaacggaaccccacgggtacccaaacccccgtcttaccggtacccaccgtttcccttacccggttaccccccaacccttttccctcgtttaaccncctttcccncggttctaccgggg

SEQ ID NO: 340828 - DNA, 576 bp, Homo sapiens
  misc_feature: GZ8MTXP02HL8J1.11.59.F04.1.454.CMB.2.raw
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
tcagcgagagataccacgaccggtgctcgatttagtacacacacttagggattggggctgggagaggagcccagcactagaagtcggcggtgtctccattcggtgatcagcactgaacacagaggactcaccatggagtttgggctgaactgggttttcctcgtagctcttttaagaggtgtccagtgtcaggtgcaactggaggagtcgtgggggagcgtggtccagccgtgggagtccctgagactctctgtacngcctntggcttcaccttcattacctatggcatgcacgtgggtcccnccagcctccgaggcgagggggctgggagtgggtgctagtttnttcatatgataggaaatgtncttctattcagactcgtagacggcgtatccgcgtctcaganactatccgagacacgacgtcttagtacttcgtacgactaaatcgaaacgacgtaccgaggacgagacgtaggaacggtacgaccgggtacgttagttacgttaacgttacgttaggtaggtaacgtaaaagttactttacgtaagttacggtaggttacggtaaccgggg

SEQ ID NO: 340829 - DNA, 593 bp, Homo sapiens
  misc_feature: GZ8MTXP02ITXIG.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatggttggtcgttaataagtatgtctcatcggtaccgcacgaacccaggaccaaaccgccccccaagtccgttctctatgatgtacactaagccgcctcgaggtctcctgactcgtacttctacgtcggtcctaccgtagtctacggaccaaccgacccggtccctaccgtacgaacctactccgtcgtcgggcctacccgaggtccgtaggaggtagtcggacggtcttagttatttaagtttgtgtcgttagtctacgtaagttagtacggtaacttaccttacttctttacgtcgttacggacgtcggacctacgtccaccgtcgtaacggtcacgtacccacgaccctacctacgtcg

SEQ ID NO: 340830 - DNA, 656 bp, Homo sapiens
  misc_feature: GZ8MTXP02JD9NP.11.59.F04.1.454.CMB.2.raw
  modified_base (369)..(369): a, c, t, g, unknown or other
  misc_feature (369)..(369): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtcgttataagtatgtctcatggtaccgcagaaccaggcaaacgcccccaagtcgttctctatgatgtcactaagccggcctcgaggtacgtccctgactcgtattctctggcctcagtctcggaccaaccnccggccctaccctagaaacctgttcctcgtcgggcccttcccgaggccgttggaaggtatcggaaggtccttaggtaactttagttagtttcggcctttagccttacgtaagttagtacgggtaaaacgtttacccttaacgtttccctttttaccgtaccgtttacgggaaacccgttcgggggtaacccctaaccggggttcctaaccccggttccgtttaaaccgggtcccgaaccggtacccccgaaaaccgggtccccccaaaaacccccgtactttacccg

SEQ ID NO: 340831 - DNA, 615 bp, Homo sapiens
  misc_feature: GZ8MTXP02H8XWX.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgattgttggtcgttataagtatgtctcatggtaccgcacgaacccaggaccaaacgccccccaagtccgttctctatgatgtcactaagccggcctacgagacgtcctgactcgtattctctgctccagtctgaccaacgccgccctcctacgaacctatcctcgtcgggacctccgaggctagaggagtggaagtcgtagtatttagtttattcggtctcgtactacgattagtacggtaaacgttacccttaacttcctttttacgttaccgtttaccgggaaaccttacggggtaccctaaccggtcccgtaaacccggttcccgtaacgggttcccaaccggtaccccgaaaccgggccccctaaacccctaacgttcccg

SEQ ID NO: 340832 - DNA, 543 bp, Homo sapiens
  misc_feature: GZ8MTXP02JG195.11.59.F04.1.454.CMB.2.raw
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
  modified_base (539)..(539): a, c, t, g, unknown or other
  misc_feature (539)..(539): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttgtcgttataagtatgtctcatggtaccggcagaaccagcaaacgcccccaagtcgtctctatgatgtcactaagccgcctcaggtacgtccctgactcgtattctctggcctccgagttctcggacaaccgaccggccctcctagaaaccnttcctcgtcgggtctcccgaggcctggacggtntacggaggtcgtagtagtttacttattgcttgcttacgatatggtaactactacttctttcgtcttacggaactgggacctacggtccaacgtctaaggtcacgccgaacgccaaccctntccg

SEQ ID NO: 340833 - DNA, 546 bp, Homo sapiens
  misc_feature: GZ8MTXP02HTNPV.11.59.F04.1.454.CMB.2.raw
  modified_base (254)..(254): a, c, t, g, unknown or other
  misc_feature (254)..(254): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtggcagtcagtcaccatcccctgcactggaaccagcaatgatgttggtcttataagtatgtctnatggtaccggcagaacccaggaccaaacgccccccaagtcgttctctatgatgtcactaagcggccctcgaggacgtccctgactcgattctctgctcagtcgtggaccaaccgaccggtccctccctagaaacctatcctcgtcgggcctcccgaggctaggaggagtcgaggtctagtatttagttattgctgctacatagtaggtaactccttattcttttcacttacggaactcgggaactcgtacaccgtcgtaaggtcaacggcccaacggcccaaccctacgtcg

SEQ ID NO: 340834 - DNA, 549 bp, Homo sapiens
  misc_feature: GZ8MTXP02HSKO6.11.59.F04.1.454.CMB.2.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccngcaatgatgttggtcgttataagtntgtctcatggtaccgcaagaacccaggaccaaacgcccccaagtcgttctctatgatgtcactaagccgcctcaggacgtccctgactcgattcnctgcctcagtctggcacncgcctcctnacatctctcggctcagctgagntgagntgtatttattatgctgctactattagtacggtaaacgttaccttaactttcttttcgtaccgtttacggaaacgtcgggtacctacgggtccctaacccggttctaacggtccaacggtacccaaacggacccctaaaccccgtctaccg

SEQ ID NO: 340835 - DNA, 577 bp, Homo sapiens
  misc_feature: GZ8MTXP02GQ0MF.11.59.F04.1.454.CMB.2.raw
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcaagaacccaggacaaacgcccccaagtcgtctctatgatgtcactaagccggcctgaggacgtccctgactcgtattctctggcctaccagtctggacaaccgaccggcctccctagaaactntcctcgtgggctccgaggctaggaggatgagtctagtattatattgcttgctnatagtaggaacttacctactttccttttcgtacgttacggaaacgttcggggaaccctacgggtcctaacccggttaccgtaagggttacccaacggtacccccaaacggtcccccaaaaccccgtactttcccg

SEQ ID NO: 340836 - DNA, 512 bp, Homo sapiens
  misc_feature: GZ8MTXP02I5HHN.11.59.F04.1.454.CMB.2.raw
  modified_base (256)..(256): a, c, t, g, unknown or other
  misc_feature (256)..(256): n is a, c, g, or t
  modified_base (428)..(428): a, c, t, g, unknown or other
  misc_feature (428)..(428): n is a, c, g, or t
  modified_base (470)..(470): a, c, t, g, unknown or other
  misc_feature (470)..(470): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcntggtaccggcagaacccaggcaaacgccccccaagtcgttctctatgatgtcactaagcggccctcaggatccctgactcgattctctggctccagtctggccacacgcctccctgaacatctctgggctccgagctgacggatgaggctagtatttattattgactgcctnatatggaagtacctacttctttctcttcggaactgggaaccncggtcaccgtctaaggtccaacgcccaaggcccaacccatcg

SEQ ID NO: 340837 - DNA, 712 bp, Homo sapiens
  misc_feature: GZ8MTXP02JNRVM.11.59.F04.1.454.CMB.2.raw
  modified_base (272)..(272): a, c, t, g, unknown or other
  misc_feature (272)..(272): n is a, c, g, or t
tcagcgagagataccacgaccggtgctcgatttagtacacacacttaggggctggggtctcagggaggcagcactcgtcgggacgtctccaccatggcctgggctctgctcctcctcacgcctcctcactcgagggcacaggatccgtgggctcagtctgccctgactcacgccccgctcagtcgtccgggtctccgtgggcagtcagtccaccactcccctgccacgtcggaaccagacaatgattggttggtacttataagtatgtctanagtcggtaccgcacgaaccaggaccaaccgcccccaagtcgttctctatgatgtacaacgtaacgccggtaccctacgacggtaccgtcctgacctcgtacttcctcgtcggccttacgtacgtccgtacgaccaaccgaccggtaccctaccgtaagaaacctacgtccgttcggtcggggtcctacccggaggtccgtagggaacggtagtacgggaacggtcgttagttaaagtttacgtttacgttcggtccgttacggtaccttaacgtacgttaacggtacgggttaaacctttaccctttacgtttacccgtttttacccgtaacgggtaacccgttcgggaaacccgttaccggtacccgtaaccggttcccgtaaggtaaccgaaccggaacccgtaaaccggacccctaaaccccgtcgtacctaacccg

SEQ ID NO: 340838 - DNA, 643 bp, Homo sapiens
  misc_feature: GZ8MTXP02I0CHB.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctccgtgggcagtcagtccaccactccctgcactggaaccagcaatgatgttggtcttaataagtatgtctcagtggtaccggcacgaacccaggaccaaacgcccccaagtccgtctctatgatgtacaacgtaacgccggcctacgacggtacgtcctgactcgtattctcgtggacctaccgagtctacggaccaaccgaccggccctacccgtagaactactccgtcgtcggcctccgaggtctggacggagtgaggtactaggttaatttagtttagttcgtcgttgtaccttacgtaagttacgtacgggttaaacttaccctttaactttcctttttaccgttaccgtttaccgggtaaccgttacgggtaaccctaccggttaccctacccggttaccgtaacggtaccgaaccgtaccccgaacggtacccctaaccctacgttcccg

SEQ ID NO: 340839 - DNA, 698 bp, Homo sapiens
  misc_feature: GZ8MTXP02HVQQE.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatggttggtacgttataagtatgtctcagtggtaccgcacgaacccaggaccaaacgcccccaagtccgttctctatgatcgtccaactaacgccggtcctacgaggtacgtcctgactcgtattctctggcctacagttcgtggaccaaccgaccggtccctaccgtacgaaacctactccgtcgtcggggccctcccgtagggcctagggacggtactgggaacggtcttaggttaattttagtttacgttgccgttcgtcttacgtaagttaacggtagggttaaacctttaccctttacttttcccgtttttacgtacccggttttaaccggggaaaaccgttccgggggtaaacccctaacgggggtttcccctaacccgggtttacccgttaaacggggttacccgaaaccggtacccccggaaaaccggtaccccctaaaacccccgttcgtttacccgg

SEQ ID NO: 340840 - DNA, 556 bp, Homo sapiens
  misc_feature: GZ8MTXP02FUTRM.11.59.F04.1.454.CMB.2.raw
  modified_base (232)..(232): a, c, t, g, unknown or other
  misc_feature (232)..(232): n is a, c, g, or t
  modified_base (505)..(505): a, c, t, g, unknown or other
  misc_feature (505)..(505): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccgnagaacccaggcaaacgccccccaagtcgttctctatgatgtcactaagccggccctgaggacgtccctgactcgattctctggctccaagtctggcaacaccggcccctccctgaacactctcgtgggcctccaggctgagatgaggctgtaattattattgcttgcttcatagtaggaacttaccttactttcttttcctcgtttcggaaacgttcgggaaccctacgggtccacccgttcgtaggtccacgacccaaacggcccaaacccnctcgtaccactcctcgtaccccaaccttcctcgtactcctctccgtgacgg

SEQ ID NO: 340841 - DNA, 558 bp, Homo sapiens
  misc_feature: GZ8MTXP02F8DIU.11.59.F04.1.454.CMB.2.raw
  modified_base (224)..(224): a, c, t, g, unknown or other
  misc_feature (224)..(224): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcgttataagtatgtctcagtggtaccggcaacgaacccaggacaaaccgccccccaagttccgttctctatgtatgtcaactaacgccggtccctacgaggactccctgacctcgattctctgcctcagtctggacaccaccggcctcctgaacntccncgtggctcgaggctagagatgacgtctagtatttagttntgcttgctacagtagtaggtaacttaccttcttcttttctcgttacggaacgttgggaccctacggtccaccggttaccgaaggttaccacggtaccccaaggcccctaaaccccgtctacg

SEQ ID NO: 340842 - DNA, 785 bp, Homo sapiens
  misc_feature: GZ8MTXP02JEUPN.11.59.F04.1.454.CMB.2.raw
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcttataagtatgtctcatggtaccgcagaacccaggacaacgcccccaagtcgttctctatgatgtcactaagccggccctcgacggtacgtcccgtagacttcgatttctcgtcggtcctccgaacgttctcggaccaaccgaccggtccccctccctagaacctacttcgtccgttcggggcctaccgacgggtaccgttagggaagggtagttacggaacggggttccttaggtaaatttaactttaagtttcggtcccgtttagcctttacgtaattagtaaacgggtaaacgtttaaccccttaaccttttaccgttttttcgttacccgtttaaccgggtaaaccgtttacgggggttaaacccgtttacccggggtaacccgttaaccccgggtttacccgttaacggggttacccgtaaccggtaacccccgtaaaaccgggtacccccaaacccccggtaaacttaccggtcccttaaacccgttccctttcccggttaacccccctaaccccgtttcccgtttaccgttaaccctttccgtacccggtccgtttaacgggtacccgggg

SEQ ID NO: 340843 - DNA, 591 bp, Homo sapiens
  misc_feature: GZ8MTXP02ICIUF.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccactcccctgccactggaaccagcaatgatgttggtcttataagtatgtctcagtggtaccgcacgaacccaggacaaaccgccccccaagtccgtctctatgatgtccataacgccggccctcgaggcgtccctgactcgattctctcggcctccagtcctggaccaaccgaccggtccctaccctagaaacctcttccgtccgtcgggcccttacccgaggtcctaggaggtatgggagtacgtgtaatttagttatcggtctaggcctacgtattagtaggtaacttaccttacttccttttactcgttacggaaccggttcggacccgtacgtcctacccgtcgtaacgaccacgacccgaacgaccccaacccgtactccg

SEQ ID NO: 340844 - DNA, 687 bp, Homo sapiens
  misc_feature: GZ8MTXP02G6YGH.11.59.F04.1.454.CMB.2.raw
  modified_base (225)..(225): a, c, t, g, unknown or other
  misc_feature (225)..(225): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccactccctgcactggaaccngcaatgatgttggtcttatagtatgtctcagtggtaccggcacgaacccgaggacaacgcccccaagtcgtctctatgatcgtacactaacgccggtcctcgacggtacgtcctgacctcgtacttctcgtcggcctacctagtctacggaccaaccgccggtccctccctacgaacctactccgtcgtcgggccctacccgaggtccgtaggacggtagtcgggacggtcttaggttaatttagtttacgttcggtccgttacggtaccttacgtaagttacggtacgggttaaaccgtttaccctttaaccgtttccctttttacgtacccggttttaacgggtaaacccggtttaccggggaacccgttacccgggtacccgtaccccggttaccggttaaccgggttacctaaccggttacccgaaaccggtaccccctaaaccccggtacttacccg

SEQ ID NO: 340845 - DNA, 522 bp, Homo sapiens
  misc_feature: GZ8MTXP02IWLPY.11.59.F04.1.454.CMB.2.raw
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (427)..(427): a, c, t, g, unknown or other
  misc_feature (427)..(427): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaacgccccccaagtcgtctctatgatgtcactaagcggccctcaggacgtccctgactcgattctctggcctcagtctggccaacnccggcctcctgaacntctctgggctccgaggctgaggatgagctagtattattattgctgcctnatagtaggaattacctacttcttttactcgttacggactcgggaccacggtccaccgtctaaggtcacgtacccaacggccccaacccgtactcg

SEQ ID NO: 340846 - DNA, 530 bp, Homo sapiens
  misc_feature: GZ8MTXP02FWC23.11.59.F04.1.454.CMB.2.raw
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggacaaacgccccccaagtccgttctctatgatgtcactaagcgccctnagagtccctgactcgattctctggctcagtctggcaacncgcctcctgaacntctcgtgggctcgagctgagntgagctgattatattgctgctgatagtaggtaagtaccttacttcttttactcgtttacggaaactggggaccctacgggtacctacccgttccgtaacggtcgacgaccccgaacggcccaaaccccgtctacg

SEQ ID NO: 340847 - DNA, 659 bp, Homo sapiens
  misc_feature: GZ8MTXP02G3R8W.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccgcacgaacccaggaccaaacgccccccaagtccgttctctatgatgtacactaacgccggaccctcgacggtacgtccccgtagacctcgtactttctacgtcggtccttaccgtacggtctacggaccaaaccgtaccggccctaccctacgaacactccgtacgtcgggcctaccgaggtcctaggaggtagtggacgtcgttaggtaaatttagtttagttgtaccttcgaccttacgtaacgttaaggtagggtaaacctttaccgttactttcctttttaccgtacgtttaccggaaccggttacgggaaccctaccgggttaccctacccggttaccgtaacggtaccgaaccgtaccccgaaccggaccccctaaacccctcgttacccg

SEQ ID NO: 340848 - DNA, 676 bp, Homo sapiens
  misc_feature: GZ8MTXP02GKDHG.11.59.F04.1.454.CMB.2.raw
  modified_base (491)..(491): a, c, t, g, unknown or other
  misc_feature (491)..(491): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatgttggtcgttaataagtatgtctcagtggtaccggcacgaacccaggacaaacgccccccaagtcgttctctatgatgtcactaagccggcctcgaggactccctgactcgattctctggctcagtctggaccaacgtaccggccctcctagaaaccattccgtcgtcgggccttacccgacgggtcctaggacggtaagtcggacgggtaccttaggtaactttaagttttaagtcggtaccttggtacccctttanaactttaaggtaacggggtaaaaccgtttaacccctttactttacctttttccgttaccgtttaccggggtaaaccgtttaccggggaaacccttaccggggttaccctaacccggtttaccgttaaccggggtaccaaccggtacccccgaaacggaccccctaaaaccccctcgtttacccgg

SEQ ID NO: 340849 - DNA, 533 bp, Homo sapiens
  misc_feature: GZ8MTXP02FX7XR.11.59.F04.1.454.CMB.2.raw
  modified_base (359)..(359): a, c, t, g, unknown or other
  misc_feature (359)..(359): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccggcagaacccaggcaaacgcccccaagtccgttctctatgatgtcactaagcgccctcagagtccctgactcgatctctggcctcagtctggcaacnccgcctccctgaaacatcctcgtcgggctccgtaggctagacggatggagctgatttattattgcttgcttcgatataggaagttacctattcttttctcttaccggtaactcgggacctacgggttccaaccgttcctaacggtcacgacccaacggcccaaacccgcttccg

SEQ ID NO: 340850 - DNA, 580 bp, Homo sapiens
  misc_feature: GZ8MTXP02H8E0U.11.59.F04.1.454.CMB.2.raw
  modified_base (266)..(266): a, c, t, g, unknown or other
  misc_feature (266)..(266): n is a, c, g, or t
  modified_base (370)..(370): a, c, t, g, unknown or other
  misc_feature (370)..(370): n is a, c, g, or t
tcagcgagagataccacgaccggtgctcgatttagtacacacacttagggattgggggcttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggacaaacgccccccaagtcgttcnctatgatgtcactagcggcctcaggacgtccctgatcgattctctggctcaagtctggacaacgcgcccctccctagacatctcgcgggcctccgagcctgagngtgaggctagatttatattgcttgctacagtagtcggtaaacgttaccttactttcttttcgttcgttcgggtaacgtcgggtacctaccggtacctaccggtccttaaggtccacggaccccaacggaccccaacccctacttacgtccaaccgttccttcccgttcccccgtccccgttccttaccgttactccctcctcgtcctcgg

SEQ ID NO: 340851 - DNA, 579 bp, Homo sapiens
  misc_feature: GZ8MTXP02HEH8A.11.59.F04.1.454.CMB.2.raw
  modified_base (224)..(224): a, c, t, g, unknown or other
  misc_feature (224)..(224): n is a, c, g, or t
  modified_base (437)..(437): a, c, t, g, unknown or other
  misc_feature (437)..(437): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcgttataagtatgtctcatggtaccggcagaacccaggacaaacgccccccaagtccgttctctatgatgtcactaagcgccctcaggacgtccctgactcgattctctgcttcagtctggacacacgcctcctagaacatctcgtcgggctccgaggctggaggatggagctagtattatttacgttgcttgaccttnaagttagtagggtaacttaccttacttctttttacgtaccgtttacgggaaacgttcggggaaccgtaccggtccgtaacccggttcgttaaggggtcccacggtaccccgaaacggaccccctaaaccccgtacttacccg

SEQ ID NO: 340852 - DNA, 553 bp, Homo sapiens
  misc_feature: GZ8MTXP02F8TT4.11.59.F04.1.454.CMB.2.raw
  modified_base (224)..(224): a, c, t, g, unknown or other
  misc_feature (224)..(224): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccgcacgaacccagcaacgccccctaagtcgttctctatgatgtcactaagccgcctcaggctccctgactcgatctctggctcagtctggacacgacgcctccngaacntctcgtggctcaggctgagntgngctgattattattgactgcctcgtatagtagggaacttacccttacttccttttacgtccgtttacgggaacttcggggaccctacgggtcccaccgttacccgtaacgggttaccaaccggtaccccgaacggtaccccctaaaccccgtcctttaccg

SEQ ID NO: 340853 - DNA, 529 bp, Homo sapiens
  misc_feature: GZ8MTXP02FT1XD.11.59.F04.1.454.CMB.2.raw
  modified_base (172)..(172): a, c, t, g, unknown or other
  misc_feature (172)..(172): n is a, c, g, or t
  modified_base (364)..(364): a, c, t, g, unknown or other
  misc_feature (364)..(364): n is a, c, g, or t
  modified_base (432)..(432): a, c, t, g, unknown or other
  misc_feature (432)..(432): n is a, c, g, or t
  modified_base (523)..(523): a, c, t, g, unknown or other
  misc_feature (523)..(523): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcttataagtatgtctcatggtaccggcagaacccaggaccaaacgccccccaagtcgttctctatgatgtcactaagccggcctcgaggctcctgactcgattctctggcctcagtctggacaacncgcctccctagaactatcctgcgggcctccgaggctgagatgaggctagtattagttattggctgctnatagtcggaatacctactttctttactcgtttacggaactcgggacctacggtccaccgttcctaacggcacgtccaacggtccaaacccnctaccg

SEQ ID NO: 340854 - DNA, 633 bp, Homo sapiens
  misc_feature: GZ8MTXP02F1BHT.11.59.F04.1.454.CMB.2.raw
  modified_base (174)..(174): a, c, t, g, unknown or other
  misc_feature (174)..(174): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgntcaggtcgtccgggtctccgtgggcagtcagtcaccactccctgcacgtggaaccagacaatgatggttggtacttaataagtatgtctcagtcggtaccgcaacgaacccaggaccaaaccgccccctaagtctctctatgatgtacacgtaacgccgtcctcgacgtcgtcctagtacgtcgtacttctcgtcggacctacgtacgtcgtacggacaaacccgccggtaccctaccgtagaaactcttccgtcgtacggtcctaccgaggtctaggagtagtacggaggtacttaggtaaatttagtttacgttcggtacttcgtacctacgtaagttacggtaacggtaacttaccctttacttcctttacgtccgttacggtaccgttacggacctaccggtactacccgttacgaacggtccaaccggacccaacgacccctaacccgttctcg

SEQ ID NO: 340855 - DNA, 524 bp, Homo sapiens
  misc_feature: GZ8MTXP02JQ558.11.59.F04.1.454.CMB.2.raw
  modified_base (399)..(399): a, c, t, g, unknown or other
  misc_feature (399)..(399): n is a, c, g, or t
  modified_base (518)..(518): a, c, t, g, unknown or other
  misc_feature (518)..(518): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccgcagaacccaggcaaacgcccccaagtcgttctctatgatgtcactaagccggcctcaggacgtccctgactcgattctctggctcagtctggcacgacgcctcctgaaccatctcgtcgggctccgaggctgacgntgaggctgattattatgctgctcatagtggaacttccttactcttttcacgtttcggaaccttcggggacctacgggtcctaccggttctaacggtcacgacccgaaggccccaacccngtaccg

SEQ ID NO: 340856 - DNA, 711 bp, Homo sapiens
  misc_feature: GZ8MTXP02II5B7.11.59.F04.1.454.CMB.2.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagcccgctcagtgtccggtctcctgggcagtcagtcaccatccctgcactggaaccngcaatgatgttgtcgttataagtatgtctnatggtaccgcagaaccaggacaacgcccccaagtcgtctctatgatgtacactaagcgccctgacggacgtcctgactcgattctctgctcagtctaggaccaaccgaccgcctaccctagaaacctatccgttcgtcgggcttacccgagggtccgttaggaacgggtattacggaacggtactttaggttaaattttaacgttttaagtttcggtaccgtttacggtaccttacgtaaagtttaacggttaacggggtaaaacctttaaccccgtttaaccttttcccgttttttttaccgtacccggtttttaaacccggggaaaacccgttttacgggggaaaccccgttaaccgggggttaaccccttaaccccggtttaccgttaacggggttacccaaacggtaccccccgaaaacgggtacccccctaaaacccccgtaacgtttaccccgg

SEQ ID NO: 340857 - DNA, 544 bp, Homo sapiens
  misc_feature: GZ8MTXP02ISGUI.11.59.F04.1.454.CMB.2.raw
  modified_base (265)..(265): a, c, t, g, unknown or other
  misc_feature (265)..(265): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggatcagtctgccctgactcagccccgctcagtgtccgggtctcctgggcagtcagtcaccatcccctgcactggaaccagcaatgatgttggtcgttataagtatgtctcatggtaccgnagaacccaggcaaacgccccccaagtcgtctctatgatgtcactaacgccggccctcgaggtacgtcctgactcgtattctctgctcagtctgcacncgctccngacntctcgnggctccgagctgagntgaggctagtattattatgctgcttnattagtaggtaacgttaccttacttcttttacgtcgtttacggaacgttcggacccgtacggtaccctaccggttccgtaaggtaccacggtaccccgaacggacccctaacccgtacttcccg

SEQ ID NO: 340858 - DNA, 604 bp, Homo sapiens
  misc_feature: GZ8MTXP02H2SY4.11.59.F04.1.454.CMB.2.raw
  modified_base (425)..(425): a, c, t, g, unknown or other
  misc_feature (425)..(425): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcagccccgctcagtgtcccgggtctcctgggcagtcagtcaccatcccctgcactggaaccagcaatgatgttggtcgttataagtatgtctcatggtaccggcagacccaggcaacgccccccaagtcgtctctatgatgtcactagccggcctcgagagtccctgactccgattcgtctcggactccagtcgtgccaaccgaccgcctccctagaccatcctccgtgggcctcccgaggccgtaggtacggatggaggnttacgagtttatttattagccgtgctctatagtgtaacgttactaccgttcttttacgtaccgtttaccgggaacgttaccgggaacgttacccggtacccgtaacccggttacccgtaacggttacccgtacgaacccccggtaccggtacccccggtaaaccccctaccgttacccg

SEQ ID NO: 340859 - DNA, 525 bp, Homo sapiens
  misc_feature: GZ8MTXP02F07LA.11.59.F04.1.454.CMB.2.raw
  modified_base (141)..(141): a, c, t, g, unknown or other
  misc_feature (141)..(141): n is a, c, g, or t
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (516)..(516): a, c, t, g, unknown or other
  misc_feature (516)..(516): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttataagtatgtctcatggtaccggnagaacccaggacaaacgccccccaagtcgttctctatgatgtcaactaagccggccctnaggatccctgatcgattctctggctccaagtctggcaaaccacggccccctccctgaaacatctctggggcctccgaggctgagatgaggctagtatttatatgctgctnatnagatacctatctttcnctcgaactggacccaggtcacgtctaggcacgacccaacgcccaacccactcgtaccacttcctccgttccccaaccctctcgtactcctacncctgaccgg

SEQ ID NO: 340860 - DNA, 512 bp, Homo sapiens
  misc_feature: GZ8MTXP02FMGA4.11.59.F04.1.454.CMB.2.raw
  modified_base (321)..(321): a, c, t, g, unknown or other
  misc_feature (321)..(321): n is a, c, g, or t
  modified_base (374)..(374): a, c, t, g, unknown or other
  misc_feature (374)..(374): n is a, c, g, or t
  modified_base (424)..(424): a, c, t, g, unknown or other
  misc_feature (424)..(424): n is a, c, g, or t
tcagcgagagataccacgaccggtgctcgatttagtacacacacttaggggctggggtctcaggaggcagcactctcgggacgtctccaccattgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctnaggagtcccctgactcgattctctggctccagtctggcaacacggcctccctnaacatctctgggctccagctgaggatgaggctgattattattgctgcttnatatggaagtacctacttcttttctcttcggaaactgggaccacggtcaccgttcctaaggtcacgccccaaggcccaaccccactcg

SEQ ID NO: 340861 - DNA, 585 bp, Homo sapiens
  misc_feature: GZ8MTXP02HNKQP.11.59.F04.1.454.CMB.2.raw
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcaagtgtccgggtctcctgggcagtcagtcacatccctgcactggaaccagcaagtgatgttggtcgttataagtatgtctcatggtaccggcagaacccaggcaaacgcccccaagtccgtctctatgatgtcactaagccggccctcaggacgtccctgatcgaattctcgtggctccaagttctggcaaacnccggcccctcccngacatcncgtgggctccaggctggacgagtgacgggcttagaattattatgctgcctnatactaggaacttaccttacttcttttacgtcgtttacggaacttcgggaccacggtccaaccgtcgtacggtcacgaccccgaacggaccccaaaccctacgtaccggtaccaaccgttcgtaccccgttaccccctaacccttccgtccgttactcccttccgtccgtcgtccgg

SEQ ID NO: 340862 - DNA, 526 bp, Homo sapiens
  misc_feature: GZ8MTXP02FMDYF.11.59.F04.1.454.CMB.2.raw
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccgcagaacccaggacaaacgccccccaagtcgttctctatgatgtcactaagccgccctcaggngtccctgactcgattctctggctcagtctggacacaccggcctcctgaacatctctgggctccgaggctgaggatgagctgtatttatattgactgctcattataggaagtaccttacttctttcgtcgttacggtaacgtcgggaccacggttccaccgtccgtaaggtcacgtacccaacggtcccaacccgacttccg

SEQ ID NO: 340863 - DNA, 682 bp, Homo sapiens
  misc_feature: GZ8MTXP02IV3UD.11.59.F04.1.454.CMB.2.raw
  modified_base (230)..(230): a, c, t, g, unknown or other
  misc_feature (230)..(230): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtgtcccgggtctccgtgggcagtcagtcaccactccctgccacgtggaaccngcaatgattggttggtacgttataagtatgtctcatggtaccgcacgaacccaggacaaaccgcccccaagttccgtctctatgatcgtacaactaacgccggtccctagacggtacgtccctagacctcgtacttctcgtcggcctacctagtcgtacggaccaaccgaccggtccctacccgtagaacctactcgtcgtcggcctacccgaggtctaggacggtagtacggacggtcttaggttaagttttaatttaagttcgtaccgttgtacccttagtaagttacggtaaggttaaccgtttaaaccctttactttccgtttttcccgttaccggtttaccgggtaaaaccgttccggggttaaaccccttaccggggtaccccttaccggtaccgtaacggtcccgaaccgtacccgaacggtacccccaaacccgttactacccg

SEQ ID NO: 340864 - DNA, 572 bp, Homo sapiens
  misc_feature: GZ8MTXP02H11DF.11.59.F04.1.454.CMB.2.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttgtctataagtntgtctnatggaccgnagaaccaggcaaaccgccccaagtcgtctctangatgtcactaagccggccctcgaggacgtccctgactcgattctctggctccaagtctaggcaacgcggcccctccctagaacactctcgtcggctccgagcctgagtngaggctgtattacttatgcttgctctatagttggaacttacctttattcctttttactcgtttaccggaacgttcggaacctaaccggtctaacccgtcgttacgggtccaacggtccccaaacggcccctaaacccctcgtacgtcctactcccgtttcgtcccccgtcccttcgtaaccgtctcgtcccttcgcgtcgg

SEQ ID NO: 340865 - DNA, 509 bp, Homo sapiens
  misc_feature: GZ8MTXP02JHXFQ.11.59.F04.1.454.CMB.2.raw
  modified_base (365)..(365): a, c, t, g, unknown or other
  misc_feature (365)..(365): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttgtcttataagtatgtctcatggtaccgcagaacccaggcaaagccccccaagtcgtctctatgatgtcactaagcgcctcagactcctgactcgattctctggctcagtctggcacacgcctcctgaacntctctggctcagctgacgatgagctgattattatgctgctgatagtggaacttacctattcttttctactttcggaaactggggaaccctacggtcctaccggtcctaaggtccacgtacccgaaggcccaaaccccgtactcg

SEQ ID NO: 340866 - DNA, 544 bp, Homo sapiens
  misc_feature: GZ8MTXP02FL3OM.11.59.F04.1.454.CMB.2.raw
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggccaaacgccccccaagtcgttctctatgatgtcactaagccggccctcgaggacgtcctgatcgattctctggctccaagtctggcaacacggcccctccctgaacatctcgtgggcctccgaggcctgaggtatggaggcttagtatttattattgctgctcatataggaactacctacttcttttctcgttacggactcgggaccacggtcaccgtccaggtcacgacccaacggcccaaaccccactcgtaccacctcctcgttaccccaaccctctccgtactcctctcgctcgg

SEQ ID NO: 340867 - DNA, 566 bp, Homo sapiens
  misc_feature: GZ8MTXP02F4079.11.59.F04.1.454.CMB.2.raw
  modified_base (466)..(466): a, c, t, g, unknown or other
  misc_feature (466)..(466): n is a, c, g, or t
  modified_base (559)..(559): a, c, t, g, unknown or other
  misc_feature (559)..(559): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcacgaacccaggacaaaccgcccccaagtcgttctctatgatgtcaactacgccgccctgagacgtccctgacctcgtacttctctcggcctacacgtctacggaccaaccgaccggtccctacccgtagtaaacctcttccgtcgtacgggcctacccgaggtctagaggatgagtctagtattagttattcgcttgcctnattacgtaggtactaccttcttctttcgtcgttacggaactcgggacctacggtccaccgttctaacgtccacgacccgacgccctaaacccngttaccg

SEQ ID NO: 340868 - DNA, 544 bp, Homo sapiens
  misc_feature: GZ8MTXP02FJ4EI.11.59.F04.1.454.CMB.2.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgnagaacccaggcaaacgccccccaagtcgttctctatgatgtcactaagcggcctnaggatccctgatcgattctctggctccaagtctggcaacacgcccctcctgaacatctctgggcctccgaggctgagatgagctgatttattattgctgctcgattagtaggtaacttaacctactttcttttcncgtttacggaacgttagggaccctacggtccaccgttccgtaggtccacgcccgaacggacccaacccctctcgtaccacttctcgttccccaaccgtcctacgtactctctcgctacgg

SEQ ID NO: 340869 - DNA, 651 bp, Homo sapiens
  misc_feature: GZ8MTXP02IPKHU.11.59.F04.1.454.CMB.2.raw
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgttctctatgatgtcaactaagcggcccctcgaggacgtccctgactcgatttctctggcctccaagtctggcaacgccggtcccctcccctgaaccactctcgttcgggcctccgaggcctagaggatggagctgatttatattgtactgtctctattagtaggtaacttacccttactttcctttttacctcgttttaccgggaacttccgggggaccctacggggttacctacccggttaccgtaacgggttacccgaacggaccccccgtaaaacgggaccccctaaaacccccgtcttaccggtacccttaaccgttcccttaccgtttccccccaaccccgtttcccttaccgtttaccttcccgttcctttccgccgtttacggg

SEQ ID NO: 340870 - DNA, 602 bp, Homo sapiens
  misc_feature: GZ8MTXP02J2P7L.11.59.F04.1.454.CMB.2.raw
  modified_base (172)..(172): a, c, t, g, unknown or other
  misc_feature (172)..(172): n is a, c, g, or t
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtcgtccgggtctcctgggcagtcagtcaccatccctgcactggaaccngcatgatgttgtcttatagtatgtctcagtcggtaccgcagaacccaggaccaaacgcccccaagtcgtctctangatcgacactacgccggccctgacggtacgtcctagacctcgtacttcgtcgtcggaccttacgagtctacgggaccaaccgtaccgggtcccttacccgtagaaacctacgtccgtcggtacggggtaccctccgacgggtcctagggaggtactcggacggtctagtactttattacgttgccttgcctactaatagtacgtaaacgttaccttacttcttttccgcgttacggacgtcggtacctacggtcctaccgtacgtaaggtaccgacgacccaacggtccccaaccgtactccg

SEQ ID NO: 340871 - DNA, 594 bp, Homo sapiens
  misc_feature: GZ8MTXP02JHQZ3.11.59.F04.1.454.CMB.2.raw
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctcatgatgtcactaagccggccctgaggactccctgactcgattctctggctccgaagtctgcaacgccggcccctcctagaacatctcgtcgggcctccgaggcgtagaggatggaggtctagtatttagttagttgctgctactaattagtaggtaacgttaccttactttcttttacgttcgttacggtaacgtcgggtaccctacgggtctaacccgtctagggtaccacggaccccgaaacggacccctaaaccccgtacgtcgttacctaccgttcctccgttacccccaacccttcctacgtactccgtcttccgtctacgg

SEQ ID NO: 340872 - DNA, 551 bp, Homo sapiens
  misc_feature: GZ8MTXP02JCKRP.11.59.F04.1.454.CMB.2.raw
  modified_base (225)..(225): a, c, t, g, unknown or other
  misc_feature (225)..(225): n is a, c, g, or t
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (446)..(446): a, c, t, g, unknown or other
  misc_feature (446)..(446): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccngcaatgatgttggtcgttatagtatgtctcatggtaccgcacgaacccaggacaaaccgccccccaagtcgttctctatgatgtacactacgccgcctcgagacgtccctnacgtcgattctcgtgcctccagtctcggtacaaccgaccgcctccngaaacnctctccgtgggcctccgaggtctaggagatcggagctagtatttattatcgctgcctnatagtacggtaaactccttacttctttctcgttacggacgtcgggacctaccggtaccaccggttctaagggtccacggtacccaaccgaccccaaccgtactcg

SEQ ID NO: 340873 - DNA, 538 bp, Homo sapiens
  misc_feature: GZ8MTXP02I27DV.11.59.F04.1.454.CMB.2.raw
  modified_base (216)..(216): a, c, t, g, unknown or other
  misc_feature (216)..(216): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (369)..(370): a, c, t, g, unknown or other
  misc_feature (369)..(370): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttgtcgttataagtntgtctcatggtaccgcagacccaggccaaacgcccccaagtcgttctctatgatgtcactaacgcggcccctcaggacgtcctggatcgacttctcgtggcctcaagtctgcaacnccgcccctccngaacatctcnggctccnggctgacgnngagctgtattatntgctgctctatnaggaacttacctcttactttctcgttacggagttccggacctacggtacaccgttctaaggtcacgtacccgacggacccaacccacgtagtcctactccgtccgttaccccaacccgtcctcgtactctccctcgacgtcgg

SEQ ID NO: 340874 - DNA, 544 bp, Homo sapiens
  misc_feature: GZ8MTXP02I9APG.11.59.F04.1.454.CMB.2.raw
  modified_base (225)..(225): a, c, t, g, unknown or other
  misc_feature (225)..(225): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctcctgggcagtcagtcaccatcccctgcactggaaccngcaatgatgttggtcttataagtatgtctcagtggtaccgcacgaacccaggaccaaaccgcccccaagtccgttctctatgatgtacacgtaagccggcctcgacgacgtccctgacctcgattctcgtgctcagtctggacacgccgcctcctagaacatcctcgtcgggctccgagctagacgagtgagtctagtatttagttagttgcctgtctacgtagttagtaggtaacttaccttacttctttactcgttacggacgtacggacctacgtcctaccgtctaacggtcacgtcccgaacgcccaccgatccg

SEQ ID NO: 340875 - DNA, 606 bp, Homo sapiens
  misc_feature: GZ8MTXP02H6CLJ.11.59.F04.1.454.CMB.2.raw
  modified_base (494)..(494): a, c, t, g, unknown or other
  misc_feature (494)..(494): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtacgttataagtatgtctcatggtaccgcagaaccaggacaacgcccccaagtcgttctctatgatgtacactaacgccggcctcgaggcgtccctagacgtcgtacttctcgtcggccttaccagtccgtggaccaaccgaccggtccctacccgtagaaacctatccgtccgtcgggcctccgaagggtccgtaggaagggacgttggacgggtaccttggttaaactttatttagttacggtcttcgaccttanagttagacggttaacgttacctactttcgttttactcgttacggacgttcgggaaccctcggtcctaccgtacgtaacgtccaacgtaccgaacgccccaacccgtactccg

SEQ ID NO: 340876 - DNA, 730 bp, Homo sapiens
  misc_feature: GZ8MTXP02FVRWG.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccactcccctgcactggaaccagcaatgatgttggtcgttataagtatgtctcatggtaccgcacgaacccaggacaaacgcccccaagtcgttctctatgatgtcactaacgccggccctcgacggtactcccgtgaccttcgtatttccgtcgttcggtacccttaccgaaggttcctacggggacctaaaacccgacccgggtaccccttaccccgttaacgaaaccctactttcccgtacggttcggggacccttaccccgaaagggccgttaagggaacgggtacgttagggacgggtacttaggtaaattttaatttacgttcgtccgttagtacccttataagttaacggtacgggtaaacgttacccctttaacgtttcctttttaccgtaccggtttaaccgggtaaaccggttccggggtaaaccccgtacgggttacccgtacccggtttaccgtaacggttacccgaaccggtacccccgaaacggtacccccaaaaccccgttcgttacccgg

SEQ ID NO: 340877 - DNA, 597 bp, Homo sapiens
  misc_feature: GZ8MTXP02I7XIE.11.59.F04.1.454.CMB.2.raw
  modified_base (325)..(325): a, c, t, g, unknown or other
  misc_feature (325)..(325): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagcggccctcgaggacgtccctgatcgattctctggctccaagtcngcaacgcggcccctcctgacatctcgtgggctcgaggctgaggatggagtctgtatttattagttcgcttgctctatatggaacttacctattcgttttctcttacgggtaacttcgggaccctacgggtacacccggttaccgtggtccacggaccccaaacgggcccctaaaaccccctcgttccggtacctaaccctttccgttcccggtttacccccccgtcccccgttccgttacccgttacttcccgttccgtccggtcgttacgg

SEQ ID NO: 340878 - DNA, 533 bp, Homo sapiens
  misc_feature: GZ8MTXP02F9CZP.11.59.F04.1.454.CMB.2.raw
  modified_base (397)..(397): a, c, t, g, unknown or other
  misc_feature (397)..(397): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagccggccctcaggactccctgactcgattctctggcctcagtctggcacacgcctcctgaacatctcgtgggctcgagctgaggntgagctgtattattatgctgctcatagtacggaagttaccttacttcctttttctcgtttacgggaacttcggggaccctacggtccaccgttccgtaaggtccacggacccaacggccccaaaccccgcttaccg

SEQ ID NO: 340879 - DNA, 639 bp, Homo sapiens
  misc_feature: GZ8MTXP02IXCKY.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcaggtgtccgggtctccgtgggcagtcagtcaccactcccctgcactggaaccagcaatgattgttggtacgttataagtatgtctcagtcggtaccgcaacgaacccgaggaccaaaccgacccccaagtccgttctctatgtatcgtacaactaacgccggccctcgacgtacgtccgtgtacctcgtacttctcgtcggtacctaccgtagtctacggaccaaccgacccggtccctaccgtacgaacctactccgtcgtcgggcctccgacgtcgtagacggtagtaggaggcgttttttttttagatttagtttagttgtcgtcgtactacgtattacgtacggtaacgttaccttactttactttacttacgttaccggtacgtacgggtaccgtaccgtaccgtacccgtaccgtaacggtacgaccgacccgaaccgacccaacccgtacctaccg

SEQ ID NO: 340880 - DNA, 589 bp, Homo sapiens
  misc_feature: GZ8MTXP02GNH09.11.59.F04.1.454.CMB.2.raw
  modified_base (255)..(255): a, c, t, g, unknown or other
  misc_feature (255)..(255): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctnatggtaccggcagaacccaggaccaaacgccccccaagtcgttctctatgatgtacactaagccggccctcgaggacgtccctgactcgattctcgtgcctcagtctaggcaaccgacggccctcctgaaactatcctcgtcggggcctcccgaggcctaggaggatggaggtctaggtaatttagtttagttggacttgtacctacgtaattagtaggtaacgttaccttactttccttttactcgtttacggaacgttcgggaccctaccggtacctacccgttccgtaaggtaccacgacccgtaaccggccccaaacccccgtgttaccg

SEQ ID NO: 340881 - DNA, 551 bp, Homo sapiens
  misc_feature: GZ8MTXP02IJNBS.11.59.F04.1.454.CMB.2.raw
  modified_base (331)..(331): a, c, t, g, unknown or other
  misc_feature (331)..(331): n is a, c, g, or t
  modified_base (387)..(387): a, c, t, g, unknown or other
  misc_feature (387)..(387): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcaggtgtccgggtctcctgggcagtcagtcaccatccctgcactggaaccagcaatgattgttggtcgttataagtatgtctcagtggtaccggcagaacccaggaccaaacgcccccaagtcgtctctatgatgtcactaagcgcctgagacgtccngactcgattctctgctcagtctgaccacgaccggcctaccctagaacctatctcgngggacctccgagctgacggatgagtctagtatttattagttgctgctacagttagtaggtaacttacctactttcttttctacgtttcggaaacttcggggaaacctcggtaccctaaccgtcgtaacgtacacgacccaacggcccctaaacccgtcgtaccg

SEQ ID NO: 340882 - DNA, 587 bp, Homo sapiens
  misc_feature: GZ8MTXP02GBWB9.11.59.F04.1.454.CMB.2.raw
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccactcccctgcactggaaccagcaatgatgttggtcgttataagtatgtctcatggtaccggcacgaaccaggcaaacgacccccaagtcgttctctatgatgtcactaagccggccctcaggngtccctgactcgtattctctggctcagtcncgcacacggctccctagaacatcctcgtggtcctccgacggtcctggacggatgaggacgttagtaatttatttaattcgcgttcgcctactatagttacggtaacgttaccttactttctttttcctccgtttacgggtaacgtacggggtacccacgggttcctaaccgttccggtaaggttccaaccggtacccaaccgggtacccaaaccccggtactacccgg

SEQ ID NO: 340883 - DNA, 599 bp, Homo sapiens
  misc_feature: GZ8MTXP02IIX6F.11.59.F04.1.454.CMB.2.raw
  modified_base (331)..(331): a, c, t, g, unknown or other
  misc_feature (331)..(331): n is a, c, g, or t
  modified_base (597)..(597): a, c, t, g, unknown or other
  misc_feature (597)..(597): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaaccatcccctgcactggaaccagcaatgaatgttggtacttataagtatgtctcagtcggtaccgcaacgaaccgaggacaaacgccccctaagtcgttctactactgatgtacactaagcggccctnaggactccctgaccgtccgtattcctctcggtcctaccacggtctacgggacctaaaccgaccggtccctacccgtagaaccctatcccgtcgtcgggcctacgacggccgtaggagacgtgaacgggtcttaggttatttaacgtttagtcgtcgtgtacctataacgtagtacggtaaactcctacttcttcttactcgttacgaacgtcggacctacggtctaccggtaacctacggtcacggacccacggtaccccaacccncg

SEQ ID NO: 340884 - DNA, 303 bp, Homo sapiens
  misc_feature: GZ8MTXP02HS4IJ.11.59.F04.1.454.CMB.2.raw
  modified_base (295)..(295): a, c, t, g, unknown or other
  misc_feature (295)..(295): n is a, c, g, or t
  modified_base (301)..(303): a, c, t, g, unknown or other
  misc_feature (301)..(303): n is a, c, g, or t
tcagcgagagataccacgaccggtgctcgatttagtacacacacttagggattgggcagcctgacatctgaggacacggccatatattactgtgcaatcagttataggacgtcgtccgagggctactttgactcttgggccagggaaccctggtcaccgtctcctcagcctccaccaagggcccatcggtcttccccctggcgccctgctccaggagcacctccgagagcacagcggccctgggctgcctggtcaaggactactccgtatctctcgctgagcggctggcaaggcncatagnnn

SEQ ID NO: 340885 - DNA, 558 bp, Homo sapiens
  misc_feature: GZ8MTXP02FFQSB.11.59.F04.1.454.CMB.2.raw
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
  modified_base (429)..(429): a, c, t, g, unknown or other
  misc_feature (429)..(429): n is a, c, g, or t
  modified_base (500)..(500): a, c, t, g, unknown or other
  misc_feature (500)..(500): n is a, c, g, or t
tcagcgagagataccacgaccggtgctcgatttagtacacacacttagggattggggggctttccctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttaataagtntgtctcatggtaccgcagaacccaggaccaaacgcccccaagtcgttctctatgatgtcactaagcgccctgaggatccctgatcgattcnctggctccaagtctggcaacaccggcctccccctgaacatctctggctccgagctgacggatgagtctagtatttattagttgctgctactaatagtggaaacttaccctattctttcncgttcgaacttcggggacctacggtcctaccggttcctaggtccacgacccgaaacgcccaaaaccccctntccgtactacctcctccctacccctaccctccgtcgttactcctcgacgcgtcggacg

SEQ ID NO: 340886 - DNA, 736 bp, Homo sapiens
  misc_feature: GZ8MTXP02H8WQP.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactggaaccagcaatgatgttggtcgttataagtatgtctcatggtaccggcacgaacccaggacaaacgccccccaagtcgttctctatgatgtcactaacgccgccctcgaggacgtccctgtacctacgtactttctcgtcggtaccttaccgtacgttccgttacggacccgtaaacccgtacccgggtccccttaccccgttaacgaaaccctacgtcccgttccgtcgggtcccttacccgacgggtaccgttagggaacgggtaacgttgggaacggtcgttaggttaaacttttaagtttacgttacgtccgttagtacccttacgtaacgtttaaggtacggttaaaccgttaccctttaccgtttttccctttttaccgttacgttttaacccggggtaaacgttaccggggtaaaccccgttaccgggttacccgttacccggttacccgttaacggtacccgaacggtaacccccgtaaaccgggaccccctaaccctaaccgttcccg

SEQ ID NO: 340887 - DNA, 665 bp, Homo sapiens
  misc_feature: GZ8MTXP02JWJER.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtcgtccgggtctccgtgggcagtcagtccaccactcccctgccacgtacggaaccagacaatgtattggttggttacgttaataagtatgtctcagtcggtaccgcaacgaacccgaggaccaaaccgccccctaagttccgttctctagtgtactcgtaccgaacgtaacggcccgtccctacgacgggtacctcccgtgtacctccgtattccgtcgtcgcctaccagtctacggaccaccgcccgtccctccgagaacctctcgtcgtcggcctcgaggtcgtaggaggtatagggacgtcgttaggttaatttagtttagttcgtccgttgtactacgtaagttacggtacggttaacctttacctttactttcgttttaccgtacggttaccgggtacgtacccgggaccgtaccggtaccctacccgttacgtaacggtacccgaaccgtacccgtaaccgacccctaacccgcgttaccg

SEQ ID NO: 340888 - DNA, 512 bp, Homo sapiens
  misc_feature: GZ8MTXP02FW268.11.59.F04.1.454.CMB.2.raw
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (394)..(394): a, c, t, g, unknown or other
  misc_feature (394)..(394): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtcgttctctangatgtcactaagcggccctnaggatccctgatcgattctctggctcaagtctggcaacncggcccctccctgaacatctctcgggcctcaggctgaggatcggagctgtattattatgcttgctnatatagaagttaccttacttcttttctcttcggaacgtggacccaggtcaccgtctaggtcacgccaacgcccaaacccnctnccactctcgtcccgcctcncgtactctctcgctgg

SEQ ID NO: 340889 - DNA, 642 bp, Homo sapiens
  misc_feature: GZ8MTXP02J2R0E.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttaataagtatgtctcagtggtaccgcacgaaccaggacaaacgcccccaagtccgttctctatgatgtacactaagccggtcctcaggactcccgtgactcgtattcctcttcggccttaccgagtccgtacggaccaaaccgccggtaccctcccgtacgaaacctacgttcctcgttacgggcccttcccgagggtcctaggacggtagtacggaggtcctagtaattatttagttgtactcgtacttactataacgtacgggtaacgttaccttaacgttctttttccgtacgtttaccggaacggttaccgggacctaccgggtaccgtaaccgttacccgtaacgggttaccaccggtaccccaaccgggtacccccaaacccccgtacttacccg

SEQ ID NO: 340890 - DNA, 717 bp, Homo sapiens
  misc_feature: GZ8MTXP02IN107.11.59.F04.1.454.CMB.2.raw
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccactcccctgcactggaaccagcaatgatgttggtcgttataagtatgtctcatggtaccgcagaacccaggaccaaacgcccccaagtcgttctctatgatgtacaactaacgccggccctacgacggacgtccctgacttccgtattctcttcggcttaccgtaacgtccgtacggaccaaaccgtaccggtcccccttacccccgagtaacctacttccgtccgttcggggccttaccgaacgggtcctagggacgggatgggacgggtcttagtaatttagttactttcggaccttggcttactaattacgtacggtaaacttacccttacttttcctttttacttacgttaccgggtaacgttaccggggtaacccttaaccgggttacctacccggttaccgttacgggtacctaaccgggtaacccccaaaacggaccccctaaaccccgtactccgttacctacccgtttacccttcccggttaccccctaacccgttcccgttccgtaccttcttacccgtcggtccttaccgggg

SEQ ID NO: 340891 - DNA, 607 bp, Homo sapiens
  misc_feature: GZ8MTXP02H42A7.11.59.F04.1.454.CMB.2.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcaggtgtccgggtctccgtgggcagtcagtccaccatcccctgcactggaaaccagacaatgattggttggtcgttaataagtatgtctnagtggaccgcacgaaccagacaaacgcccccaagtcgtctctangatgtcaactaaggccgcctagacgacgtccctgacctcgtattctctcggcctacagtctaggaccacgaccgtcctcctagaactactctcgtcgggcctccgaggctaggaagtacgtgagcttagtatttattagtgtctcgctacgtaatagtacggaaacttacccgttactttccttttccgtacgtttaccgggaaacgtccggggtaacccgtaccggtacccgtaaccggtccgttaacgggaccacccggaacccaaccgggaacccccctaaccccaacgttcccg

SEQ ID NO: 340892 - DNA, 572 bp, Homo sapiens
  misc_feature: GZ8MTXP02GLWJ7.11.59.F04.1.454.CMB.2.raw
  modified_base (400)..(400): a, c, t, g, unknown or other
  misc_feature (400)..(400): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtccaccatcccctgcactggaaccagcaatgatgttggtacgttataagtatgtctcagtcggtaccggcaacgaacccaggaccaaaccgccccccaagttccgttctctatgtatgtacactaacgccggccctcgaggacgtccctgactcgattctctggcctacagtctggacaccgaccgcctccagaaccntccgtcgtcgggcctccgaggctaggacggatggacgtctagtatttattagttgcttgcctatattagtaggtaacttaccttactttcttttactacgttacggaacgtcgggacctacggtcctaccgttcgtaacggtccacgtcccgaacgcccaacccgtctaccg

SEQ ID NO: 340893 - DNA, 629 bp, Homo sapiens
  misc_feature: GZ8MTXP02HRL9R.11.59.F04.1.454.CMB.2.raw
  modified_base (250)..(250): a, c, t, g, unknown or other
  misc_feature (250)..(250): n is a, c, g, or t
  modified_base (374)..(374): a, c, t, g, unknown or other
  misc_feature (374)..(374): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctggactcagtctgccctgactcagccccgctcagtgtccgggtctcctgggcagtcagtcaccatcccctgcactggaaccagcaatgatgttggtcgttaataagtntgtctcagtggtaccgcaacgaacccaggaccaaacgcccccaagtccgttctctatgatgtcactagccggcctgagtacgtcctgacctcgattctcgtgcctacagttccgtgaccgaacnccgggtccctccctagaactctcttcgtgggccctccgaggtctggaggtacgtggacgggtccttaggttaacttttagtttagttcgtcgttcgcgttactaagttacggtacggttaaacgttacccttaacttttccctttttcgtaccgttttacggaaaccgtttcggggaaccctaccgggtcccttaacccggttcctaacgggttccaaccgtaccccgaaacggtacccccaacccgtactaccg

SEQ ID NO: 340894 - DNA, 538 bp, Homo sapiens
  misc_feature: GZ8MTXP02HRPS5.11.59.F04.1.454.CMB.2.raw
  modified_base (140)..(140): a, c, t, g, unknown or other
  misc_feature (140)..(140): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttgtcgttataagtatgtctnatggaccgnagaacccnggcaaacgcccccaagtcgtctctatgatgtcactaagccggcctcaggctccctgatcgattctctgctccaagtcnggcacacgcccctccngacntctcgnggctcagcngagatgagctagattatatgctgctnatatggtaactaccttacttcttttctcgttacggaaacctggggaccctacgggtccacccgtcgtaacgggtccacgccccctaaacggacccctacccacttcgtccaccttcctacgttccccaaccgttcctccgtactccgtcctcgtcctagg

SEQ ID NO: 340895 - DNA, 717 bp, Homo sapiens
  misc_feature: GZ8MTXP02GH7LZ.11.59.F04.1.454.CMB.2.raw
  modified_base (423)..(423): a, c, t, g, unknown or other
  misc_feature (423)..(423): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtccaccatcccctgcactggaaccagacaatgatgttgtacgttataagtatgtctcagtcggtaccgcacgaaccgaggaccaaaccgacccccgaagttccgttctactatcgtatcgtacaacgtaacgcccggtcctacgacggtacgtcccgtagacctcgtattctcgtcggcctacgagtctacggaccaaccgaccgtccctccgtagaaacctntccgtcgtcgggtccctcccggaggtccgtaggacgggtagtacgggtacggtacttaggtaattttagtttacgttcgtacggtttcgacccttagtaagttaacggttaacgggtaaaccgtttaccctttacgtttccctttttaccgttaccggtttaaccgggtaaccggttacccgggggtaacccgttacccggggttacccgtaaccccggtttccggtaacggttaccccgaacccggtacccccggaaaccggacccccctaaaaccccgtccgtttaacccgg

SEQ ID NO: 340896 - DNA, 635 bp, Homo sapiens
  misc_feature: GZ8MTXP02IFH1A.11.59.F04.1.454.CMB.2.raw
  modified_base (328)..(328): a, c, t, g, unknown or other
  misc_feature (328)..(328): n is a, c, g, or t
tcagcgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggaccaaacgcccccaagtcgttctctatgatgtcactaagcggccctcaggacgtcctgatcgattctctgctcaagtctgcaacncgcccctcctgaactatctcgtcggctccgaggctagaggatggagctagtactttattagtgtctgccttcaagttacgtaggtaaacgtttacccttaccttacctttttcgttaccgtttaccgggtaacgttaccggggtacccgtaccgggttaccctacccggttaccgttacggtaccgacgtacccccgaaacggtcccccaaaccccgtaccgttccgtaaaccctccttaccgttcccgtttacccccaaccccttcccgttaaccggtttcctaccgttccgttccggtactcggg

SEQ ID NO: 340897 - DNA, 701 bp, Homo sapiens
  misc_feature: GZ8MTXP02HCZT3.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgattggttggtcgttaataagtatgtctcagtggtaccggcacgaacccaggaccaaacgccccccaagtcgttctctatgatgtacaactaacgccggtccctcgaacggtcgtcccctgactcgtatttcctcgtcggtcctacctagttcctacgggaccaaaccgtacccgggtcccctacccgtacgaaacctacttccgtccgtcggggccttaccccggaggtccgtagggaacgggtactagggacgggtaccttaggttaagtttacgtttaagttcgtacgttacgacttacgtaagttagttacgggtaaactttacccttactttcctttttacgtaccgtttaccgggtaaaccgttcggggtaaccccgtaccggttacccgtaacccggttaccgtaacggtacccgaccggtacccccgaaaccgggtaccccctaaacccccggtaacttcccg

SEQ ID NO: 340898 - DNA, 673 bp, Homo sapiens
  misc_feature: GZ8MTXP02JMDKE.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctccgtgggcagtcagtcaccatccctgcactggaaccagcaatgatgttggtcttataagtatgtctcatcggtaccgcaacgaccaggacaaacgcccccaagtccgtctctatgatgtacacgtaacgccgcctcgaggtactcctgacctcgtacttctacgtcggctaccagtcctacggaccaaccgaccggtccctaccctacggaaacctacgttcccgtacgtcggggtacctaccccgtaaggtccgtaggaacggtagtacggtaggtaccgttaggtaatttacttagttcgaccgttagaccttacacgttaaggtacggtaaacgttacccttaacgttccttttaccgttaccgttaccgggtaaaccggttaccggggaacccgtaccggttacccgtaacccgttaccggtaacggtacccgtaaccggtaccccgaaaccggtaccccctaaaccccgtacgttacccg

SEQ ID NO: 340899 - DNA, 612 bp, Homo sapiens
  misc_feature: GZ8MTXP02FRDYT.11.59.F04.1.454.CMB.2.raw
  modified_base (497)..(497): a, c, t, g, unknown or other
  misc_feature (497)..(497): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtcaccactcccctgcactggaaccagcaatgattggttggtacgttaataagtatgtctcagtcggtaccgcaacgacccaggaccaaacgccccctaagtccgttctctatgtatgtacaactaacgccggccctgacggactcccgtagacctcgtacttctcgtcggccttaccagtctacggacctaaccgcccggtccctacccgtagaaacctcttccgtcgtcgggtccctcgacggtctaggacggatggacgtctagtaactttagttagtcgacttgaccttnaagttagtacggtaacttaccttacttctttacgtacgttacggacgtacggacctacgtacctacccgttacgtaacggtacaacggacccgaacgacccaacccgtacgtccg

SEQ ID NO: 340900 - DNA, 696 bp, Homo sapiens
  misc_feature: GZ8MTXP02HTY7C.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcaacggaaccccaggaccaaaacgcccccccaaagtccgttctctatgatgtacaactaagccggccctacgaggactccctgactcgattctctggtcctactagtcgtaggaccaaacccgtaccgggtcccctacccgtagaaacctcttccgtcgttcggggcctcccgagggtccttaggaggtattcgggaacggtccttaggtaattttaagtttagttcggtaccttcggtcttacgtaagttacgtacgggtaaaaccgttacccgtttaactttcccgtttttaccgttaccgtttaacccggggtaaacgttaccgggggtaaccccttaaccggggttacccctaacccgggttacctaacggggttacccaaccggtacccccgaaacggtaccccccaaaaccccgtccgtttaccg

SEQ ID NO: 340901 - DNA, 709 bp, Homo sapiens
  misc_feature: GZ8MTXP02FWSP4.11.59.F04.1.454.CMB.2.raw
  modified_base (142)..(142): a, c, t, g, unknown or other
  misc_feature (142)..(142): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcacgccccgntcagtgtccgggtctcctgggcagtcagtcgccatcccctgcactggaaccagcaatgatgttggtcttataagtatgtctcagtggtaccgcaagacccaggaccaaacgcccccctaagtcgttctactatgatgtcaacgtacgccgcctgaggactcctgactcgtattctcgtcggtacctccgtaagttccgtaggaccaaaccgtaccggtcccccttaccccgtacgtaaacctacgttccgtccggttcggggtcctaccggagggtccgttagggaaggtacgtcgggacgggtctaggttaacttttaattcgttcgacttacgccttactaagttacgtacgggtaaaccgtttaaccctttacgtttcctttttccgttaccggtttaccgggtaaaccgggttaccgggtaccccgtaacgggttccctaacccggttccgtacgtaccgacgtaccccgaaacggtacccccaaaccctacgtcgtccaaccgttccgtaccctttacccccaaccgtttccctaacgttcctccgtcgttccgacgtcggg

SEQ ID NO: 340902 - DNA, 679 bp, Homo sapiens
  misc_feature: GZ8MTXP02I1UE5.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccactccctgcactggaaccagcaatgatgttgtcgttataagtatgtctcatcggtaccgcacgaaccaggacaaacgaccccctaagtccgttctctatgatcgtacacgtaacgccggtaccctacgacggtacgtcccgtagtaccgttccggtaactttccgtcttcgggtacccttaccgtaacggttccgttacgggacctaaaccgtcccggtacccctacccgtacggaaacctacgttccgtcgtacggggcccttacccgtacggtcgtaggacggattcggaggtcgttagtagtttaacgtttattcggcttacgtctactacgttagttacggtaaacgttacctttactttaccgtttttacgtaccgtttaccgggaacgttcgggaacccttaccggtaccgtaccgtaccggttaagccgaacgtcccgaaacggacccctaacccgtacgttcccg

SEQ ID NO: 340903 - DNA, 785 bp, Homo sapiens
  misc_feature: GZ8MTXP02HZK3G.11.59.F04.1.454.CMB.2.raw
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatccctgcactggaaccagcaatgatgttggtcgttataagtatgtctcagtcggtaccgcacgaacccaggccaaacgcccccaagtcgttctctatgatgtacactaacggccgccctgacggactccctgactcgacttctctcggctacgtaagttcgtggtaccaaacgtccggtcccccttacccgttacgaaactacgttccgttaccggttcggggtccttaccggaacggggttcctacggggtaacgggtacgttacgggaacgggtccttaggttaaacttttaacgtttacgttcggtacctttcggtaccccttagtaaacgttacggttacgggtaaaaccgtttaccccgttttaccttttccttttttacccgttaccggtttaacccggggtaaacccggtttccgggggtaaaccctaccggggttacccgttaccccggttccgttaaccgggtaccgaacccgtaaccccggaaaccgggaccccctaaacccccgtacgttccggtaaccctaccgttcccgttaacccctttacccccaaccccggtttccctttacggtaccttccttacccgttccggtacgtcggg

SEQ ID NO: 340904 - DNA, 670 bp, Homo sapiens
  misc_feature: GZ8MTXP02ILT9A.11.59.F04.1.454.CMB.2.raw
  modified_base (224)..(224): a, c, t, g, unknown or other
  misc_feature (224)..(224): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcgttaataagtatgtctcatggtaccggcaagaacccaggacaaaccgcccccaagtcgttctctatgatgtacactaagccgcctgaggacgtccctgactcgtattctcgtcggcctaccagtccgtacggaccaaaccgccggtccctaccctaggaaaaccctgtccttcgtcggggcccttcccgaggtccgttaggaaggtacgttaggacggtacgttaggtaaattttaagttttacttcgggtcttacggtaccttaccgaagtttacgtagggtaaaacctttaccctttaccgtttaccttttttcgaccgttttaccggaaacgttccgggaacccttaccggtccgtaaccccgttaccgtaacggttaccaaccggtaccccgtaaaaccgacccccgtaaaacccccttgtacccgg

SEQ ID NO: 340905 - DNA, 549 bp, Homo sapiens
  misc_feature: GZ8MTXP02JPHUA.11.59.F04.1.454.CMB.2.raw
  modified_base (172)..(172): a, c, t, g, unknown or other
  misc_feature (172)..(172): n is a, c, g, or t
  modified_base (381)..(381): a, c, t, g, unknown or other
  misc_feature (381)..(381): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttataagtatgtctcatggtaccgcagaacccaggcaaacgccccccaagtcgtctctatgatgtacactaagcggccctcgaggacgtccctgactcgattctctggctcagtctggaccacaccggcctccctgaaccntcgtcgtgggcctcgagctgagatgaggctgtaatttagttattgcttgctacattagtaggaacgttacctacttcttttctacgtttcggaaacgttcgggacctacgggtcctacccggtccgtaacgtcaacggacccgaacgacccaaccccgactccggggg

SEQ ID NO: 340906 - DNA, 546 bp, Homo sapiens
  misc_feature: GZ8MTXP02IXPDI.11.59.F04.1.454.CMB.2.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (384)..(384): a, c, t, g, unknown or other
  misc_feature (384)..(384): n is a, c, g, or t
  modified_base (434)..(434): a, c, t, g, unknown or other
  misc_feature (434)..(434): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgatgttggtcttataagtatgtctcagtggtaccgcagaacccaggacaaacgcccccaagtcgtctctangatgtcactaagcgcctnaggacgtcctagactcgtattctctgctacagtctaggcaaaccgccgtccctcctagaaacctntctcgtcgggctccgagctagagatgagctagtattattatgtctgctanatagtaggtaacttaccttacttcttttctacgtttcggaaaccgttcgggaacctacgggtcctacccgtcgtaacggtaccacggacccaaggacccaaccccgtactcg

SEQ ID NO: 340907 - DNA, 535 bp, Homo sapiens
  misc_feature: GZ8MTXP02FVNRF.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgttctctatgatgtcactaagcggccctcacggagtccctgactcgattctctgctcagtctggcacacgcctccctgaacatctcgtgggctccaggctggagatgagctgattattattgctgctcatagtaggaacgtaccttacttcttttctacttacggaacgtcgggaacctaccggttccaacccgttcctaagggttccaacgtacccgaacggaccccaacccgtacttacg

SEQ ID NO: 340908 - DNA, 707 bp, Homo sapiens
  misc_feature: GZ8MTXP02FX62D.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtgtccgggtctccgtgggcagtcagtcaccactcccctgccacgtaggaaccagacaatgattggttggtacgttaataagtattgtctcagtcggtaccgacagaacccaggaccaaaccgcccccaagtcctctctatgatgtacactaacgccggccctacgaggacgtccctagacctcgtactttctctcggcctaccgagtcctacggaccaaaccgaccggtccccttacccgtagtaaaccctagttccccgttacgtaccggggcccttacccgaagggtccttaaggggaggtacgtagggacggtaccttaggttaatttagtttacgttcgtcgttaggtcccgttataattacggtaagggttaaaccctttacctttactttccgttttacctaccggtttaccggtaacggtccgggggttaaccccaacggggttccctaacccggttaccgtaaggggttaccccaaacggtacccccggtaaacggtaccccctaaccccgtagtttcccg

SEQ ID NO: 340909 - DNA, 632 bp, Homo sapiens
  misc_feature: GZ8MTXP02H381L.11.59.F04.1.454.CMB.2.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtccaccatcccctgcactggaaccagcaatgatggttgtcgttaataagtntgtctnagtggtaccggcacgaacccgaggacaaaccgccccccaagtccgttctctatgatcgtacaacgtaagccggtccctacgacggacgtccctaggtactcgtacttctacgtggtccttaccagtcgtaggaccaacgaccgtccctacctagtaaccatctccgtcgggcctacccgaggtccgtaggacggaagtgggacgtcgttagttaatttagtttagtcggtacttcgacttactaaacgttagtacggttaaaccgtttaccgttaactttccgttttactaccggtttaccggaaacgtccggggtacctaccggttactacccgtcgtaacggtcacgtaccccgaggaccccctaccgactcg

SEQ ID NO: 340910 - DNA, 705 bp, Homo sapiens
  misc_feature: GZ8MTXP02J3APM.11.59.F04.1.454.CMB.2.raw
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagcccgctcagtcgtccgggtctccgtgggcagtcagtccaccatccctgccactggaaccagacaattgattggttggtacttattaagtatgtctcgagtacggtaccggacaacgaacccaggaccaaacccgccccctaagtttccgttctactatcggtaatcgtaacacgtaacggccggtcctcgaaggtcctcccgtgtacctcgtacttcctacgtggaccttacgagttcctacgggcccaaaccgtcccggcctacccgtagaaacctnttccgtcgtcggggcctaccggaggtcgttaggaacggggtntagggtacgtcttaagtttaactttagttacgttcgacgttcgtacgttacgtaagttacgttaaacggttaaccttttacccgtttcttttacccgttttaccgtaccggttaaccgggtaaccggtaccgggaacccgttacccggtacccgtacccggttaccgtaaccggtaccaacccgaccccggaacccgtacccccttaacctacgttccg
